(12) United States Patent
Joshi et al.

(10) Patent No.: US 11,365,225 B2
(45) Date of Patent: Jun. 21, 2022

(54) METHOD OF MAKING RECOMBINANT SILK AND SILK-AMYLOID HYBRID PROTEINS USING BACTERIA

(71) Applicant: President and Fellows of Harvard College, Cambridge, MA (US)

(72) Inventors: Neel Satish Joshi, Somerville, MA (US); Peter Quoc Nguyen, Malden, MA (US)

( * ) Notice: Subject to any disclaimer, the term of this patent is extended or adjusted under 35 U.S.C. 154(b) by 880 days.

(21) Appl. No.: 15/776,998

(22) PCT Filed: Nov. 18, 2016

(86) PCT No.: PCT/US2016/062820
§ 371 (c)(1),
(2) Date: May 17, 2018

(87) PCT Pub. No.: WO2017/087827
PCT Pub. Date: May 26, 2017

(65) Prior Publication Data
US 2020/0291078 A1    Sep. 17, 2020

Related U.S. Application Data

(60) Provisional application No. 62/257,405, filed on Nov. 19, 2015.

(51) Int. Cl.
| | | |
|---|---|---|
| C07K 19/00 | (2006.01) | |
| C07K 14/435 | (2006.01) | |
| C12N 15/70 | (2006.01) | |
| C07K 14/47 | (2006.01) | |
| C07K 14/78 | (2006.01) | |
| C12N 1/20 | (2006.01) | |
| C12R 1/19 | (2006.01) | |

(52) U.S. Cl.
CPC ........ *C07K 14/43518* (2013.01); *C07K 14/47* (2013.01); *C07K 14/78* (2013.01); *C07K 2319/036* (2013.01); *C07K 2319/10* (2013.01); *C12N 1/205* (2021.05); *C12R 2001/19* (2021.05)

(58) Field of Classification Search
CPC ............ C07K 2319/10; C07K 2319/00; C07K 14/43518
See application file for complete search history.

(56) References Cited

U.S. PATENT DOCUMENTS

| | | | |
|---|---|---|---|
| 10,889,823 B2 * | 1/2021 | Arrieumerlou | ......... A61P 37/00 |
| 10,906,947 B2 * | 2/2021 | Kittleson | ............. C07K 14/395 |
| 2001/0042255 A1 * | 11/2001 | Karatzas | ............ C12N 15/8509 800/4 |
| 2006/0246539 A1 | 11/2006 | Weiner et al. | |
| 2012/0225453 A1 | 9/2012 | Withers, III et al. | |
| 2014/0343251 A1 | 11/2014 | Schwarz et al. | |

FOREIGN PATENT DOCUMENTS

| | | |
|---|---|---|
| EP | 2668962 A1 | 12/2013 |
| WO | 2008/019183 A2 | 2/2008 |
| WO | 2014/176311 A1 | 10/2014 |

OTHER PUBLICATIONS

International Search Report for Application No. PCT/US2016/062820, dated Feb. 16, 2017. 3 pages.
International Preliminary Report on Patentability for Application No. PCT/US2016/062820, dated May 31, 2018. 17 pages.

\* cited by examiner

*Primary Examiner* — Maryam Monshipouri
(74) *Attorney, Agent, or Firm* — Foley Hoag LLP; Dana M. Gordon; Jack Rosa

(57) ABSTRACT

Methods of making recombinant secretion of silk and silk-amyloid proteins using bacteria are provided.

8 Claims, 7 Drawing Sheets
Specification includes a Sequence Listing.

Fig. 3A Golden Silk Orb-Weaving Spider N. clavipes Repetitive Silk Domain

[MMMM] = GRGGLGGQGAGMAAAAMGGAGQGGYGGLGSQGTS (SEQ ID NO: 3)

METHOD OF MAKING RECOMBINANT SILK AND SILK-AMYLOID HYBRID PROTEINS USING BACTERIA

RELATED APPLICATIONS

This application is a 35 U.S.C. § 371 national stage filing of International Application No. PCT/US2016/062820, filed on Nov. 18, 2016, which in turn claims priority to U.S. Provisional Application No. 62/257,405, filed on Nov. 19, 2015. The entire contents of each of the foregoing applications are expressly incorporated herein by reference in their entireties.

GOVERNMENT SUPPORT

This invention was made with government support under 1420570 awarded by the National Science Foundation (NSF). The government has certain rights in the invention.

SEQUENCE LISTING

The instant application contains a Sequence Listing which has been submitted electronically in ASCII format and is hereby incorporated by reference in its entirety. Said ASCII copy, created on Nov. 17, 2016, is named 2016-11-17_117823-13120_ST25.TXT and is 818 KB in size.

FIELD

The technology described herein relates to the engineering of a polypeptide secretion system, exogenous nucleic acids encoding a recombinant protein, proteins that include a periplasmic translocation signal sequence, an outer membrane secretion signal sequence, engineered silk fibroin domains, and optionally amyloid-based extracellular matrix components produced by engineered bacterial cells.

BACKGROUND

Silks are protein fibers produced by arthropods. Large-scale production methods include cultivation of *Bombyx mori* silkworms. These silks are naturally used as a self-generated biomaterial by a wide variety of insects and are used for a diverse array of functions, such as anchoring and protection of eggs, lining of nests, binding agents for nest construction, sperm transfer, cocoon formation, and prey traps. Silk fibers possess properties of strength and elasticity that make them a highly valuable commodity. Spider silks are five times stronger on a per weight basis than steel and three times tougher than Kevlar®. Griffiths, J. R. & Salanitri, V. R. The strength of spider silk. *J. Mater. Sci.* 15, 491-496 (1980). It has a large extensibility and energy to breakage (toughness) exceeding that of most engineering materials. Gosline, J. M., Guerette, P. A, Ortlepp, C. S. & Savage, K. N. The mechanical design of spider silks: from fibroin sequence to mechanical function. *J. Exp. Biol.* 202, 3295-3303 (1999). It has also been reported that spider silk possesses a thermal conductivity 800 times greater than any other organic material. Huang, X., Liu, G. & Wang, X. New secrets of spider silk: Exceptionally high thermal conductivity and its abnormal change under stretching. *Adv. Mater.* 24, 1482-1486 (2012). Furthermore, spider silk undergoes supercontraction from temperature and pH changes. Guan, J., Vollrath, F. & Porter, D. Two mechanisms for supercontraction in Nephila spider dragline silk. *Biomacromolecules* 12, 4030-4035 (2011). However, since spiders are venomous and cannibalistic, they cannot be easily domesticated on a large scale for spider silk production.

Spider silk and other protein production has been explored in bacteria, yeast, plants, and mammalian cells. See Fahnestock, S. R. & Irwin, S. L. Synthetic spider dragline silk proteins and their production in *Escherichia coli*. *Appl. Microbiol. Biotechnol.* 47, 23-32 (1997); Xia, X.-X. et al. Native-sized recombinant spider silk protein produced in metabolically engineered *Escherichia coli* results in a strong fiber. *Proc. Natl. Acad. Sci.* 107, 14059-14063 (2010); Widmaier, D. M. et al. Engineering the Salmonella type III secretion system to export spider silk monomers. *Mol. Syst. Biol.* 5, 1-9 (2009); Fahnestock, S. R. & Bedzyk, L. A. Production of synthetic spider dragline silk protein in Pichia pastoris. *Appl. Microbiol. Biotechnol.* 47, 33-9 (1997); Yang, J., Barr, L. A., Fahnestock, S. R. & Liu, Z.-B. High yield recombinant silk-like protein production in transgenic plants through protein targeting. *Transgenic Res.* 14, 313-24 (2005); Lazaris, A. Spider Silk Fibers Spun from Soluble Recombinant Silk Produced in Mammalian Cells. *Science* (80). 295, 472-476 (2002); Widmaier, D. M. & Voigt, C. a. Quantification of the physiochemical constraints on the export of spider silk proteins by Salmonella type III secretion. *Microb. Cell Fact.* 9, 78 (2010); Sivanathan, V. & Hochschild, A. Generating extracellular amyloid aggregates using *E. coli* cells. *Genes Dev.* 26, 2659-2667 (2012).

SUMMARY

The present disclosure describes the use of a secretion system within a bacterium to secrete a silk protein, such as a silk fibroin domain. According to certain aspects, a heterologous (e.g., an exogenous or foreign nucleic acid) encoding the silk protein is introduced into a bacterium. The bacterium can proliferate and express the nucleic acid to produce the silk protein which is also secreted by the bacterium. The silk protein may be secreted such that it is unattached from the bacterium and free of the bacterium or it may be attached to the outer surface of the bacterium, such as being a component of a curli fiber. According to one aspect, the silk protein comprises a periplasmic translocation signal sequence which facilitates the transport of the silk protein from the bacterial cytoplasm to the periplasm of the bacterium. According to one aspect, the silk protein comprises an outer membrane secretion signal sequence which facilitates the transport (e.g., export) of the silk protein to the extracellular milieu, i.e., through the outer membrane of the bacterium. According to one aspect, the silk protein comprises both a periplasmic translocation signal sequence and an outer membrane secretion signal sequence. In some embodiments, the periplasmic translocation signal sequence is cleaved off of the silk protein. In some embodiments, the outer membrane signal secretion signal sequence is cleaved-off the silk protein.

Embodiments of the present disclosure are directed to methods of genetically modifying a bacterium to comprise an exogenous nucleic acid that encodes a recombinant protein nonnative to the bacterium for expression within the bacterium. The nonnative recombinant protein is secreted from within the bacterium to outside of the bacterium. The nonnative recombinant protein can also be a non-natural recombinant protein to the extent that it includes domains or molecules that are used by secretion systems within the bacterium to secrete the nonnative recombinant protein.

In one aspect, provided herein is a method of producing a genetically modified bacterium comprising genetically altering a bacterium having one or more genomic nucleic acids encoding a polypeptide secretion system to include an exogenous nucleic acid encoding a recombinant protein including a domain for periplasmic localization, a domain for directing the recombinant protein to the outer membrane for secretion and one or more silk fibroin domains, wherein the exogenous nucleic acid is under operation of a promoter to express the recombinant protein.

In some embodiments, the polypeptide secretion system is a Type VIII secretion system or a HlyA Type 1 secretion system. In some embodiments, the polypeptide secretion system includes a periplasmic secretion system and a system for secretion through the outer membrane of the bacterium. In some embodiments, the polypeptide secretion system includes a periplasmic secretion system and a system for secretion through the outer membrane of the bacterium and wherein the periplasmic secretion system is a Sec system. In some embodiments, the polypeptide secretion system includes a periplasmic secretion system and a system for secretion through the outer membrane of the bacterium and wherein the periplasmic secretion system is a twin-arginine translocation (Tat) system. In some embodiments, the polypeptide secretion system includes a periplasmic secretion system and a system for secretion through the outer membrane of the bacterium and wherein the periplasmic secretion system is a signal recognition particle (SRP) system. In some embodiments, the polypeptide secretion system includes a periplasmic secretion system and a system for secretion through the outer membrane of the bacterium and a domain for periplasmic localization is a Sec domain or a Tat domain or a signal recognition particle domain. In some embodiments, the polypeptide secretion system includes a periplasmic secretion system and a system for secretion through the outer membrane of the bacterium and a domain for periplasmic localization is a component of a Sec system, a component of a Tat system or a component of a signal recognition particle system.

In some embodiments, the polypeptide secretion system includes a periplasmic secretion system and a system for secretion through the outer membrane of the bacterium and wherein the system for secretion through the outer membrane of the bacterium is a N22 system.

In some embodiments, the polypeptide secretion system includes a periplasmic secretion system and a system for secretion through the outer membrane of the bacterium and wherein the system for secretion through the outer membrane of the bacterium is a YebF system.

In some embodiments, the polypeptide secretion system includes a periplasmic secretion system and a system for secretion through the outer membrane of the bacterium and wherein a domain for directing the recombinant protein to the outer membrane for secretion is an N22 domain or a YebF domain.

In some embodiments, the exogenous nucleic acid further encodes the recombinant protein to include one or more of an amyloid domain, an elastin domain or a collagen domain. In some embodiments, the exogenous nucleic acid further encodes the recombinant protein to include a CsgA domain.

In some embodiments, the bacterium is *E. coli*. In some embodiments, the bacterium is non-pathogenic.

In some embodiments, the silk fibrin domain includes the amino acid sequence GRGGLGGQGAGMAAAAAMGGAGQGGYGGLGSQGTS (SEQ ID NO: 3). In some embodiments, the silk fibrin domain includes 4 to 64 repeats of the amino acid sequence (SEQ ID NO: 3)
GRGGLGGQGAGMAAAAAMGGAGQGGYGGLGSQGTS.

In some embodiments, the exogenous nucleic acid further encodes the recombinant protein to include one or more functional proteins. In some embodiments, the exogenous nucleic acid further encodes the recombinant protein to include one or more functional proteins comprising an enzyme, an antibody or a detectable protein.

In one aspect, provided herein is a method for producing one or more silk fibroin domains from a genetically modified bacterium comprising providing the genetically modified bacterium in culture media conditions, wherein the genetically modified bacterium includes one or more genomic nucleic acids encoding a polypeptide secretion system and further including an exogenous nucleic acid encoding a recombinant protein including a domain for periplasmic localization, a domain for directing the recombinant protein to the outer membrane for secretion and the one or more silk fibroin domains, wherein the exogenous nucleic acid is under operation of a promoter to express the recombinant protein, and expressing the exogenous nucleic acid to produce the recombinant protein wherein the recombinant protein is secreted from the bacterium and into the surrounding culture media.

In some embodiments, the bacterium is proliferated to produce a population of bacteria cells expressing the exogenous nucleic acid. In some embodiments, the bacterium is proliferated to produce a population of bacteria cells expressing the exogenous nucleic acid to form a biofilm including the recombinant protein.

In some embodiments, the polypeptide secretion system is a Type VIII secretion system or a HlyA Type 1 secretion system. In some embodiments, the polypeptide secretion system includes a periplasmic secretion system and a system for secretion through the outer membrane of the bacterium. In some embodiments, the polypeptide secretion system includes a periplasmic secretion system and a system for secretion through the outer membrane of the bacterium and wherein the periplasmic secretion system is a Sec system. In some embodiments, the polypeptide secretion system includes a periplasmic secretion system and a system for secretion through the outer membrane of the bacterium and wherein the periplasmic secretion system is a twin-arginine translocation (Tat) system. In some embodiments, the polypeptide secretion system includes a periplasmic secretion system and a system for secretion through the outer membrane of the bacterium and wherein the periplasmic secretion system is a signal recognition particle (SRP) system. In some embodiments, the polypeptide secretion system includes a periplasmic secretion system and a system for secretion through the outer membrane of the bacterium and a domain for periplasmic localization is a Sec domain or a Tat domain or a signal recognition particle domain. In some embodiments, the polypeptide secretion system includes a periplasmic secretion system and a system for secretion through the outer membrane of the bacterium and a domain for periplasmic localization is a component of a Sec system, a component of a Tat system or a component of a signal recognition particle system. In some embodiments, the polypeptide secretion system includes a periplasmic secretion system and a system for secretion through the outer membrane of the bacterium and wherein the system for secretion through the outer membrane of the bacterium is a N22 system. In some embodiments, the polypeptide secretion system includes a periplasmic secretion system and a system for secretion through the outer membrane of the bacterium and wherein the system for secretion through the outer membrane of the bacterium is a YebF system. In some embodiments, the polypeptide secretion system includes a periplasmic secretion system and a system for secretion through the outer membrane of the bacterium and wherein a domain for directing the recombinant protein to the outer membrane for secretion is an N22 domain or a YebF domain.

In some embodiments, the exogenous nucleic acid further encodes the recombinant protein to include one or more of an amyloid domain, an elastin domain or a collagen domain. In some embodiments, the exogenous nucleic acid further encodes the recombinant protein to include a CsgA domain.

In some embodiments, the bacterium is *E. coli*. In some embodiments, the bacterium is non-pathogenic.

In some embodiments, the silk fibrin domain includes the amino acid sequence GRGGLGGQGAGMAAAAAMG-GAGQGGYGGLGSQGTS (SEQ ID NO: 3). In some embodiments, the silk fibrin domain includes 4 to 64 repeats of the amino acid sequence

```
                                         (SEQ ID NO: 3)
    GRGGLGGQGAGMAAAAAMGGAGQGGYGGLGSQGTS.
```

In some embodiments, the exogenous nucleic acid further encodes the recombinant protein to include one or more functional proteins. In some embodiments, the exogenous nucleic acid further encodes the recombinant protein to include one or more functional proteins comprising an enzyme, an antibody or a detectable protein.

In some embodiments, the recombinant protein is unattached to the bacterium. In some embodiments, the recombinant protein is attached to the bacterium.

In another aspect, provided herein is a genetically-modified bacterium comprising one or more genomic nucleic acids encoding a polypeptide secretion system and further including an exogenous nucleic acid encoding a recombinant protein including a domain for periplasmic localization, a domain for directing the recombinant protein to the outer membrane for secretion and one or more silk fibroin domains, wherein the exogenous nucleic acid is under operation of a promoter to express the recombinant protein.

In some embodiments, the polypeptide secretion system is a Type VIII secretion system or a HlyA Type 1 secretion system. In some embodiments, the polypeptide secretion system includes a periplasmic secretion system and a system for secretion through the outer membrane of the bacterium. In some embodiments, the polypeptide secretion system includes a periplasmic secretion system and a system for secretion through the outer membrane of the bacterium and wherein the periplasmic secretion system is a Sec system. In some embodiments, the polypeptide secretion system includes a periplasmic secretion system and a system for secretion through the outer membrane of the bacterium and wherein the periplasmic secretion system is a twin-arginine translocation (Tat) system. In some embodiments, the polypeptide secretion system includes a periplasmic secretion system and a system for secretion through the outer membrane of the bacterium and wherein the periplasmic secretion system is a signal recognition particle (SRP) system. In some embodiments, the polypeptide secretion system includes a periplasmic secretion system and a system for secretion through the outer membrane of the bacterium and a domain for periplasmic localization is a Sec domain or a Tat domain or a signal recognition particle domain. In some embodiments, the polypeptide secretion system includes a periplasmic secretion system and a system for secretion through the outer membrane of the bacterium and a domain for periplasmic localization is a component of a Sec system, a component of a Tat system or a component of a signal recognition particle system. In some embodiments, In some embodiments, the polypeptide secretion system includes a periplasmic secretion system and a system for secretion through the outer membrane of the bacterium and wherein the system for secretion through the outer membrane of the bacterium is a N22 system. In some embodiments, the polypeptide secretion system includes a periplasmic secretion system and a system for secretion through the outer membrane of the bacterium and wherein the system for secretion through the outer membrane of the bacterium is a YebF system. In some embodiments, the polypeptide secretion system includes a periplasmic secretion system and a system for secretion through the outer membrane of the bacterium and wherein a domain for directing the recombinant protein to the outer membrane for secretion is an N22 domain or a YebF domain.

In some embodiments, the exogenous nucleic acid further encodes the recombinant protein to include one or more of an amyloid domain, an elastin domain or a collagen domain. In some embodiments, the exogenous nucleic acid further encodes the recombinant protein to include a CsgA domain.

In some embodiments, the bacterium is *E. coli*. In some embodiments, the bacterium is non-pathogenic.

In some embodiments, the silk fibrin domain includes the amino acid sequence GRGGLGGQGAGMAAAAAMG-GAGQGGYGGLGSQGTS (SEQ ID NO: 3). In some embodiments, the silk fibrin domain includes 4 to 64 repeats of the amino acid sequence

```
                                         (SEQ ID NO: 3)
    GRGGLGGQGAGMAAAAAMGGAGQGGYGGLGSQGTS.
```

In some embodiments, the exogenous nucleic acid further encodes the recombinant protein to include one or more functional proteins. In some embodiments, the exogenous nucleic acid further encodes the recombinant protein to include one or more functional proteins comprising an enzyme, an antibody or a detectable protein.

In some embodiments, the recombinant protein is unattached to the bacterium. In some embodiments, the recombinant protein is attached to the bacterium.

In another aspect, provided herein is a non-naturally occurring protein including a fusion of a domain for periplasmic localization of the protein to periplasm of a bacterium, a domain for directing the protein to the outer membrane of a bacterium for secretion and one or more silk fibroin domains.

In yet another aspect, provided herein is a nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In another aspect, provided herein is a vector comprising a nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In yet another aspect, provided herein is a bacterium including a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In another aspect, provided herein is a bacterium including a vector comprising a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In yet another aspect, provided herein is a bacterium expressing a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In another aspect, provided herein is a biofilm including a bacterium expressing a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains. In some embodiments, the silk fibroin domains are spider silk fibrin domains which form spider silk.

In one aspect, provided herein is an engineered bacterium comprising a heterologous nucleic acid encoding a recombinant silk protein, wherein the recombinant silk protein comprises a periplasmic translocation signal sequence, an outer membrane secretion signal sequence, and a silk fibroin domain.

In one embodiment, the recombinant silk protein further comprises an amyloid domain, an elastin domain or a collagen domain. In one embodiment, the recombinant silk protein further comprises an amyloid domain. In one embodiment, the amyloid domain comprises CsgA.

In one embodiment, the engineered bacterium comprises a native polypeptide secretion system. In one embodiment, the engineered bacterium further comprises a heterologous nucleic acid encoding a polypeptide secretion system or component of a polypeptide secretion system. In one embodiment, the polypeptide secretion system is a Type VIII secretion system or a HlyA Type 1 secretion system.

In one embodiment, the polypeptide secretion system mediates the transport of a polypeptide from the cytoplasm to the periplasm of the bacterium. In one embodiment, the polypeptide secretion system mediates the secretion of a polypeptide through the outer membrane of the bacterium. In one embodiment, the polypeptide secretion system mediates the transport of a polypeptide from the cytoplasm to the periplasm of the bacterium and through the outer membrane of the bacterium.

In one embodiment, the polypeptide secretion system comprises a Sec system. In one embodiment, the Sec system comprises one or more of SecA, SecB, SecD, SecE, SecF, SecG, SecY, and YajC. In one embodiment, the polypeptide secretion system comprises a twin-arginine translocation (Tat) system. In one embodiment, the Tat system comprises one or more of TatA, TatB, TatE, and TatC. In one embodiment, the polypeptide secretion system is a signal recognition particle (SRP) system. In one embodiment, the SRP system comprises one or more of Ffh, FtsY, and 4.5S RNA.

In one embodiment, the periplasmic translocation signal sequence is a Sec signal sequence, a Tat signal sequence, or a SRP signal sequence. In one embodiment, the periplasmic translocation signal sequence is a Sec signal sequence. In one embodiment, the periplasmic translocation signal sequence is a Tat signal sequence.

In one embodiment, the periplasmic translocation signal sequence is a SRP signal sequence. In one embodiment, the SRP signal sequence comprises the signal sequence of a protein selected from the group consisting of TorT, SfmC, TraU, FocC, TreA, CcmH, FecB, YraI, TolB, AsmA, NikA, FlgI, DsbA, AppA, PcoE, BtuF, PapJ, YbcL, DsbC, ArtJ, ArtI, YraP, YcfS, FlgA, LivK, Agp, ModA, MalE, PhoA, LivJ, FepB, EcoT, MepA, AnsB, and Ivy. In one embodiment, the periplasmic translocation signal sequence comprises an amino acid sequence as set forth in SEQ ID NOs: 10-2029.

In one embodiment, the polypeptide secretion system comprises a curli export system. In one embodiment, the curli export system comprises CsgG. In one embodiment, the curli export system comprises CsgE.

In one embodiment, the polypeptide secretion system comprises a YebF export system. In one embodiment, the YebF export system comprises one or more of OmpC, OmpF and OmpX.

In one embodiment, the outer membrane secretion signal sequence comprises a CsgGE export signal sequence. In one embodiment, the CsgGE export signal sequence comprises the amino acid sequence GVVPQYGGGGNHGGGG-NNSGPN (SEQ ID NO: 2030). In one embodiment, the CsgGE export signal sequence comprises an amino acid sequence as set forth in SEQ ID NOs: 2030-2053.

In one embodiment, the outer membrane secretion signal sequence comprises a YebF signal sequence. In one embodiment, the YebF signal sequence comprises the amino acid sequence MKKRGAFLGLLLVSACASVFA (SEQ ID NO: 668).

In one embodiment, the silk fibroin domain comprises a spider silk fibroin domain. In one embodiment, the silk fibroin domain comprises the amino acid sequence GRG-GLGGQGAGMAAAAAMGGAGQGGYGGLGSQGTS (SEQ ID NO: 3). In one embodiment, the recombinant silk protein comprises 1 to 150 repeats of the silk fibroin domain. In one embodiment, the recombinant silk protein comprises 2 to 64 repeats of the silk fibroin domain.

In one embodiment, the recombinant silk protein comprises a functional protein. In one embodiment, the functional protein is selected from the group consisting of an enzyme, an antibody or a detectable protein. In one embodiment, the detectable protein is selected from the group consisting of a poly-histidine tag, a myc tag, a FLAG tag, a hemagglutinin (HA) tag, and a V5 tag.

In one embodiment, the periplasmic translocation signal sequence and the outer membrane secretion signal sequence are located N-terminal to the silk fibroin domain.

In one embodiment, the heterologous nucleic acid encoding the recombinant silk protein is operably-linked to a promoter. In one embodiment, the promoter is a constitutive promoter. In one embodiment, the promoter is an inducible promoter.

In one embodiment, the bacterium is E. coli. In one embodiment, the bacterium is non-pathogenic.

In one embodiment, the heterologous nucleic acid encoding the recombinant silk protein is located in the bacterial chromosome. In one embodiment, the heterologous nucleic acid encoding the recombinant silk protein is located in a plasmid.

In one aspect, provided herein is a biofilm comprising an engineered bacterium described herein.

In another aspect, provided herein is a method for producing a recombinant silk protein comprising culturing the engineered bacterium described herein under conditions suitable for the expression of the recombinant silk protein in the engineered bacterium.

In one embodiment, the recombinant silk protein is secreted from the engineered bacterium. In one embodiment, the recombinant silk protein forms curli fibers.

In one embodiment, the methods provided herein further comprise collecting the recombinant silk protein from the cell culture medium comprising the engineered bacterium.

In one embodiment, the methods provided herein further comprise purifying the recombinant silk protein.

In another aspect, provided herein is a recombinant silk polypeptide produced using any one of the methods described herein.

In yet another aspect, provided herein is a curli fiber formed from a plurality of recombinant silk proteins, wherein the recombinant silk protein comprise a silk fibroin domain and an amyloid domain. In one embodiment, the amyloid domain comprises CsgA.

In one embodiment, the recombinant silk protein comprises a spider silk fibroin domain. In one embodiment, the silk fibroin domain comprises the amino acid sequence of SEQ ID NO: 3. In one embodiment, the recombinant silk protein comprises 1 to 150 repeats of the silk fibroin domain. In one embodiment, the recombinant silk protein comprises 2 to 64 repeats of the silk fibroin domain.

In one embodiment, the recombinant silk protein comprises an elastin domain or a collagen domain.

In one embodiment, the recombinant silk protein comprises a functional protein. In one embodiment, the functional protein is selected from the group consisting of an enzyme, an antibody or a detectable protein. In one embodiment, the detectable protein is selected from the group consisting of a poly-histidine tag, a myc tag, a FLAG tag, a hemagglutinin (HA) tag, and a V5 tag.

In one aspect, provided herein is a biofilm comprising a curli fiber described herein.

In another aspect, provided herein is a nucleic acid encoding a recombinant silk protein, wherein the recombinant silk protein comprises a periplasmic translocation signal sequence, an outer membrane secretion signal sequence, and a silk fibroin domain.

In one embodiment, the recombinant silk protein further comprises an amyloid domain, an elastin domain or a collagen domain.

In one embodiment, the recombinant silk protein further comprises an amyloid domain. In one embodiment, the amyloid domain comprises CsgA.

In one embodiment, the periplasmic translocation signal sequence is a Sec signal sequence, a Tat signal sequence, or a SRP signal sequence. In one embodiment, the periplasmic translocation signal sequence is a Sec signal sequence. In one embodiment, the periplasmic translocation signal sequence is a Tat signal sequence.

In one embodiment, the periplasmic translocation signal sequence is a SRP signal sequence. In one embodiment, the SRP signal sequence comprises the signal sequence of a protein selected from the group consisting of TorT, SfmC, TraU, FocC, TreA, CcmH, FecB, YraI, TolB, AsmA, NikA, FlgI, DsbA, AppA, PcoE, BtuF, PapJ, YbcL, DsbC, ArtJ, ArtI, YraP, YcfS, FlgA, LivK, Agp, ModA, MalE, PhoA, LivJ, FepB, EcoT, MepA, AnsB, and Ivy.

In one embodiment, the periplasmic translocation signal sequence comprises an amino acid sequence as set forth in SEQ ID NOs: 10-2029.

In one embodiment, the outer membrane secretion signal sequence comprises a CsgGE export signal sequence. In one embodiment, the CsgGE export signal sequence comprises the amino acid sequence GVVPQYGGGGNHGGGG-NNSGPN (SEQ ID NO: 2030). In one embodiment, the CsgGE export signal sequence comprises an amino acid sequence as set forth in SEQ ID NOs: 2030-2053.

In one embodiment, the outer membrane secretion signal sequence comprises a YebF signal sequence. In one embodiment, the YebF signal sequence comprises the amino acid sequence MKKRGAFLGLLLVSACASVFA(SEQ ID NO: 668).

In one embodiment, the silk fibroin domain comprises a spider silk fibroin domain. In one embodiment, the silk fibroin domain comprises the sequence of SEQ ID NO: 3.

In one embodiment, the recombinant silk protein comprises 1 to 150 repeats of the silk fibroin domain. In one embodiment, the recombinant silk protein comprises 2 to 64 repeats of the silk fibroin domain.

In one embodiment, the recombinant silk protein comprises a functional protein. In one embodiment, the functional protein is selected from the group consisting of an enzyme, an antibody or a detectable protein. In one embodiment, the detectable protein is selected from the group consisting of a poly-histidine tag, a myc tag, a FLAG tag, a hemagglutinin (HA) tag, and a V5 tag.

In one embodiment, the periplasmic translocation signal sequence and the outer membrane secretion signal sequence are located N-terminal to the silk fibroin domain.

In one aspect, provided herein is a vector comprising a nucleic acid described herein. In one embodiment, the nucleic acid is operably-linked to a promoter. In one embodiment, the promoter is a constitutive promoter. In one embodiment, the promoter is an inducible promoter.

Further features and advantages of certain embodiments of the present invention will become more fully apparent in the following description of embodiments and drawings thereof, and from the claims.

BRIEF DESCRIPTION OF THE DRAWINGS

The foregoing and other features and advantages of the present embodiments will be more fully understood from the following detailed description of illustrative embodiments taken in conjunction with the accompanying drawings in which:

FIG. 3A and FIG. 3B schematically depict Sec-N22 secretion tag silk constructs and Sec-N22 amyloid-silk fusion constructs. The silk domain is a repetitive sequence constructed from the Golden Silk Orb-weaving spider *Nephila clavipes*, (SEQ ID NO: 3)
GRGGLGGQGAGMAAAAAMGGAGQGGYGGLGSQGTS.

DETAILED DESCRIPTION

Figure 1:
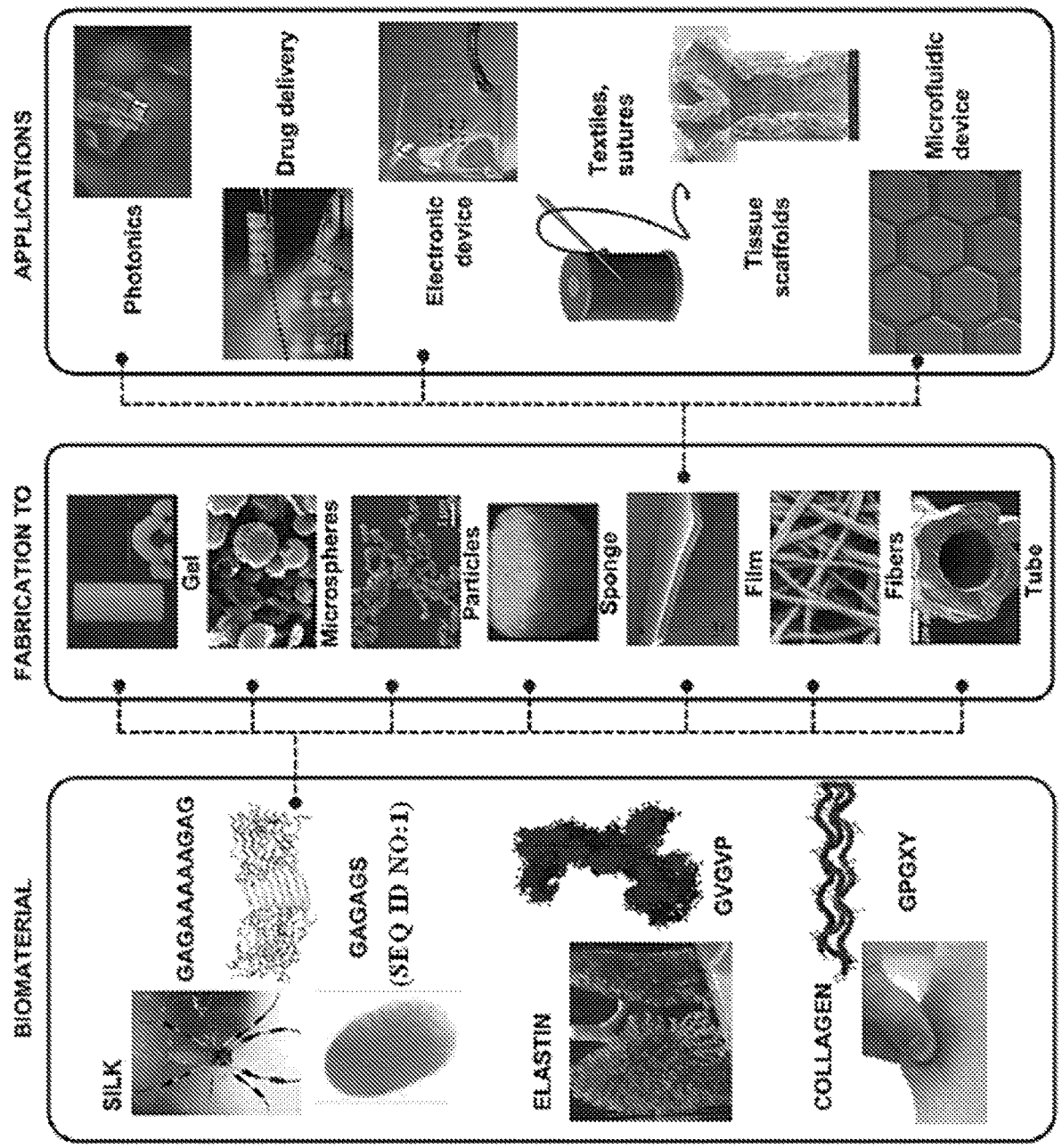
FIG. 1 schematically depicts biomaterials which may be secreted from bacteria according to methods described herein, various fabrication forms and uses.

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

As used herein, the term "engineered bacterium" or "engineered bacterial cell" refers to a bacterial cell that has been genetically modified from its native state. For instance, an engineered bacterial cell may have nucleotide insertions, nucleotide deletions, nucleotide rearrangements, and nucleotide modifications introduced into their DNA. These genetic modifications may be present in the chromosome of the bacteria or bacterial cell, or on a plasmid in the bacteria or bacterial cell. Engineered bacterial cells of the disclosure may comprise exogenous nucleotide sequences on plasmids. Alternatively, recombinant bacterial cells may comprise exogenous nucleotide sequences stably incorporated into their chromosome. In some embodiments, the engineered bacterium is non-pathogenic. In some embodiments, the engineered bacterium is pathogenic.

As used herein, the term "gene" refers to a nucleic acid fragment that encodes a protein or fragment thereof, optionally including regulatory sequences preceding (5' non-coding sequences) and following (3' non-coding sequences) the coding sequence. In one embodiment, a "gene" does not include regulatory sequences preceding and following the coding sequence.

As used herein, a "heterologous" gene, "heterologous sequence", or "heterologous nucleic acid" refers to a nucleic acid sequence that is not normally found in a given cell in nature. As used herein, a heterologous sequence encompasses a nucleic acid sequence that is exogenously introduced into a given cell. "Heterologous gene" includes a native gene, or fragment thereof, that has been introduced into the host cell in a form that is different from the corresponding native gene. A heterologous gene may include a native gene, or fragment thereof, introduced into a non-native host cell. Thus, a heterologous gene may be foreign or native to the recipient cell; a nucleic acid sequence that is naturally found in a given cell but expresses an unnatural amount of the nucleic acid and/or the polypeptide which it encodes; and/or two or more nucleic acid sequences that are not found in the same relationship to each other in nature.

As used herein, a "periplasmic translocation signal sequence", refers to a polypeptide sequence which, when present on a polypeptide, e.g., at the N-terminus of a polypeptide, can cause the polypeptide to be exported from the cytoplasm of a bacterium across the inner membrane. In some embodiments, the periplasmic translocation signal sequence facilitates transport (e.g., export) to the bacterial periplasm as mediated by a bacterial Sec system. In some embodiments, the periplasmic translocation signal sequence facilitates transport (e.g., export) to the bacterial periplasm as mediated by a bacterial twin-arginine translocation (Tat) system. In some embodiments, the periplasmic translocation signal sequence facilitates transport (e.g., export) to the bacterial periplasm as mediated by a bacterial signal recognition particle (SRP) system. In some embodiments, the periplasmic translocation signal sequence is a Sec signal sequence, a Tat signal sequence or a SRP signal sequence and homologs and/or variants, including conservative substitution variants, thereof. In some embodiments, the Sec signal sequence comprises a polypeptide having the sequence of *E. coli* CsgA SecA-dependent secretion signal and homologs and/or variants, including conservative substitution variants, thereof. Periplasmic translocation signal sequnces include, but are not limited to, SEQ ID NOs: 10-2029, as disclosed herein. In some embodiments, the periplasmic translocation signal sequence comprises an amino acid sequence having at least 80% homology (e.g., 80% or greater homology, 90% or greater homology, or 95% or greater homology), to the amino acid sequence of a periplasmic translocation signal sequence provided herein e.g. naturally occurring mutations or variants, homologs, or engineered mutations or variants. In some embodiments, the periplasmic translocation signal sequence comprises an amino acid sequence having at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of a periplasmic translocation signal sequence provided herein.

As used herein, a "signal recognition particle (SRP) pathway signal sequence" or "SRP signal sequence" refers to a polypeptide sequence which, when present on a polypeptide (e.g., the N-terminus of a polypeptide), can mediate the polypeptide export from the cytoplasm of a bacterium to the periplasmic inner membrane as mediated by the single recognition particle (SRP) pathway proteins. In some embodiments, the polypeptide is translated and transported across the inner membrane concurrently, thus guiding the nascent polypeptide into the periplasm. In some embodiments, the SRP pathway signal sequence is the SRP signal sequence from TorT, SfmC, TraU, FocC, TreA, CcmH, FecB, YraI, TolB, AsmA, NikA, FlgI, DsbA, AppA, PcoE, BtuF, PapJ, YbcL, DsbC, ArtJ, ArtI, YraP, YcfS, FlgA, LivK, Agp, ModA, MalE, PhoA, LivJ, FepB, EcoT, MepA, AnsB, and Ivy, or homologs and/or variants, including conservative substitution variants, thereof. In some embodiments, the SRP signal sequence comprises an amino acid sequence having at least 80% homology (e.g., 80% or greater homology, 90% or greater homology, or 95% or greater homology), to the amino acid sequence of a SRP signal sequence provided herein e.g. naturally occurring mutations or variants, homologs, or engineered mutations or variants. In some embodiments, the SRP signal sequence comprises an amino acid sequence having at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of a SRP signal sequence provided herein.

As used herein, an "outer membrane secretion signal sequence" refers to a polypeptide sequence which, when present on a polypeptide can cause the polypeptide to be transported across the outer membrane of a bacterial cell (e.g., a Gram-negative bacterial cell). In some embodiments, the outer membrane secretion signal sequence is a CsgGE export signal sequence. In some embodiments, the outer membrane secretion signal sequence is a YebF signal sequence. In some embodiments, the outer membrane secretion signal sequence comprises an amino acid sequence as set forth in the sequence listing. In some embodiments, the outer membrane secretion signal sequence comprises an amino acid sequence having at least 80% homology (e.g., 80% or greater homology, 90% or greater homology, or 95% or greater homology), to the amino acid sequence of an outer membrane secretion signal sequence provided herein e.g. naturally occurring mutations or variants, homologs, or engineered mutations or variants. In some embodiments, the outer membrane secretion signal sequence comprises an amino acid sequence having at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of an outer membrane secretion signal sequence provided herein.

As used herein, a "CsgGE export signal sequence" refers to a polypeptide sequence which, when present on a polypeptide can cause the polypeptide to be targeted by CsgE and exported across the outer membrane of the cell via the CsgG oligomeric transport complex of a curli export system, or by an orthologous export system. In some embodiments, the CsgGE export signal sequence comprises the last 22 amino acids of the bipartite curli signal sequence of an endogenous polypeptide exported by the curli export system. In some embodiments, the CsgGE export signal sequence comprises be a polypeptide having the sequence of an E. coli CsgA CsgGE export signal sequence (e.g., GVVPQYGGGGNHGGGGNNSGPN; SEQ ID NO: 2030; also referred to herein as N22 domain) and homologs and/or variants, including conservative substitution variants, thereof. In some embodiments, the CsgGE export signal sequence comprises an amino acid sequence as set forth in SEQ ID NOs: 2030-2053. In some embodiments, the CsgGE export signal sequence comprises an amino acid sequence having at least 80% homology (e.g., 80% or greater homology, 90% or greater homology, or 95% or greater homology), to the amino acid sequence of a CsgGE export signal sequence provided herein e.g. naturally occurring mutations or variants, homologs, or engineered mutations or variants. In some embodiments, the CsgGE export signal sequence comprise an amino acid sequence having at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of a CsgGE export signal sequence provided herein.

A "polypeptide secretion system", as used herein, refers to one or more proteins, nucleic acids, and/or cofactors that mediate the export of a polypeptide from the cytoplasm of a bacterial cell (e.g., through the inner membrane, to the periplasm, through the outer membrane, to the cell surface and/or to the extracellular milieu of a bacterial cell). In some embodiments, the bacterial cell is a Gram-negative bacterial cell. In some embodiments, the bacterial cell is a Gram-positive bacterial cell.

A "promoter" as used herein, refers to a nucleotide sequence that is capable of controlling the expression of a coding sequence or gene. Promoters are generally located 5' of the sequence that they regulate. Promoters may be derived in their entirety from a native gene, or be composed of different elements derived from promoters found in nature, and/or comprise synthetic nucleotide segments. Those skilled in the art will readily ascertain that different promoters may regulate expression of a coding sequence or gene in response to a particular stimulus, e.g., in a cell-specific or tissue-specific manner, in response to different environmental or physiological conditions, or in response to specific compounds. Prokaryotic promoters are typically classified into two classes: inducible and constitutive.

"Constitutive promoter" refers to a promoter that is capable of facilitating continuous transcription of a coding sequence or gene under its control and/or to which it is operably linked. Constitutive promoters and variants are well known in the art and include, but are not limited to, a constitutive Escherichia coli σS promoter, a constitutive Escherichia coli σ32 promoter, a constitutive Escherichia coli σ70 promoter, a constitutive Bacillus subtilis σA promoter, a constitutive Bacillus subtilis σB promoter, and a bacteriophage T7 promoter.

An "inducible promoter" refers to a promoter that initiates increased levels of transcription of the coding sequence or gene under its control in response to a stimulus or an exogenous environmental condition. A "directly inducible promoter" refers to a regulatory region, wherein the regulatory region is operably linked to a gene encoding a protein or polypeptide, where, in the presence of an inducer of said regulatory region, the protein or polypeptide is expressed. An "indirectly inducible promoter" refers to a regulatory system comprising two or more regulatory regions, for example, a first regulatory region that is operably linked to a first gene encoding a first protein, polypeptide, or factor, e.g., a transcriptional regulator, which is capable of regulating a second regulatory region that is operably linked to a second gene, the second regulatory region may be activated or repressed, thereby activating or repressing expression of the second gene. Both a directly inducible promoter and an indirectly inducible promoter are encompassed by "inducible promoter." As used herein, the term "expression" refers to the transcription and stable accumulation of sense (mRNA) or anti-sense RNA derived from a nucleic acid, and/or to translation of an mRNA into a polypeptide The term "genetic modification," as used herein, refers to any genetic change. Exemplary genetic modifications include those that increase, decrease, or abolish the expression of a gene, including, for example, modifications of native chromosomal or extrachromosomal genetic material. Exemplary genetic modifications also include the introduction of at least one plasmid, modification, mutation, base deletion, base addition, and/or codon modification of chromosomal or extrachromosomal genetic sequence(s), gene over-expression, gene amplification, gene suppression, promoter modification or substitution, gene addition (either single or multi-copy), antisense expression or suppression, or any other change to the genetic elements of a host cell, whether the change produces a change in phenotype or not. Genetic modification can include the introduction of a plasmid, e.g., a plasmid comprising at least one amino acid catabolism enzyme operably linked to a promoter, into a bacterial cell. Genetic modification can also involve a targeted replacement in the chromosome, e.g., to replace a native gene promoter with an inducible promoter, regulated promoter, strong promoter, or constitutive promoter. Genetic modification can also involve gene amplification, e.g., introduction of at least one additional copy of a native gene into the chromosome of the cell. Alternatively, chromosomal genetic modification can involve a genetic mutation.

The term "isolated" or "partially purified" as used herein refers, in the case of a nucleic acid or polypeptide, to a nucleic acid or polypeptide separated from at least one other component (e.g., nucleic acid or polypeptide) that is present with the nucleic acid or polypeptide as found in its natural source and/or that would be present with the nucleic acid or polypeptide when expressed by a cell, or secreted in the case of secreted polypeptides. A chemically synthesized nucleic acid or polypeptide or one synthesized using in vitro transcription/translation is considered "isolated."

As used herein, the term "exogenous" refers to a substance (e.g., a nucleic acid or polypeptide) present in a cell other than its native source. The term exogenous can refer to a nucleic acid or a protein that has been introduced by a process involving the hand of man into a biological system such as a cell or organism in which it is not normally found or in which it is found in undetectable amounts. A substance can be considered exogenous if it is introduced into a cell or an ancestor of the cell that inherits the substance. In contrast, the term "endogenous" or "native" refers to a substance that is naturally-present in the biological system or cell.

A "plasmid" or "vector" includes a nucleic acid construct designed for delivery to a host cell or transfer between different host cell. An "expression plasmid" or "expression vector" can be a plasmid that has the ability to incorporate and express heterologous nucleic acid fragments in a cell. An expression plasmid may comprise additional elements, for example, the expression vector may have two replication systems, thus allowing it to be maintained in two organisms. The nucleic acid incorporated into the plasmid can be operatively linked to an expression control sequence when the expression control sequence controls and regulates the transcription and translation of that polynucleotide sequence.

As used herein, the terms "protein" and "polypeptide" are used interchangeably herein to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. The terms "protein" and "polypeptide" as used herein refer to both large polypeptides and small peptides. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing.

The term "operatively linked" includes having an appropriate transcription start signal (e.g., promoter) in front of the polynucleotide sequence to be expressed, and having an appropriate translation start signal (e.g., a Shine Delgarno sequence and a start codon (ATG)) in front of the polypeptide coding sequence and maintaining the correct reading frame to permit expression of the polynucleotide sequence under the control of the expression control sequence, and, optionally, production of the desired polypeptide encoded by the polynucleotide sequence. In some examples, transcription of a gene encoding a recombinant polypeptide as described herein is under the control of a promoter sequence (or other transcriptional regulatory sequence) which controls the expression of the nucleic acid in a cell-type in which expression is intended. It will also be understood that the gene encoding a recombinant polypeptide as described herein can be under the control of transcriptional regulatory sequences which are the same or which are different from those sequences which control transcription of the naturally-occurring form of a protein.

The terms "overexpression" or "overexpress", as used herein refers to the expression of a functional nucleic acid, polypeptide or protein encoded by DNA in a host cell, wherein the nucleic acid, polypeptide or protein is either not normally present in the host cell, or wherein the nucleic acid, polypeptide or protein is present in the host cell at a higher level than that normally expressed from the endogenous gene encoding the nucleic acid, polypeptide or protein.

A "nucleic acid" or "nucleic acid sequence" may be any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable nucleic acid molecules are DNA, including genomic DNA or cDNA. Other suitable nucleic acid molecules are RNA, including mRNA.

The term "non-pathogenic" as used herein to refer to bacteria refers to bacteria that are not capable of causing disease or harmful responses in a host. In some embodiments, non-pathogenic bacteria are commensal bacteria. Naturally pathogenic bacteria may be genetically engineered to provide reduce or eliminate pathogenicity.

With respect to amino acid sequences, one of skill will recognize that individual substitutions, deletions or additions to a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid and retains the desired activity of the polypeptide. Such conservatively modified variants are in addition to and do not exclude polymorphic variants, interspecies homologs, and alleles consistent with the disclosure. A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity. Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, polypeptide described herein can be a variant of a sequence described herein, e.g., a conservative substitution variant of a polypeptide comprising the amino acid sequence of SEQ ID NO: 1. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Variant polypeptide-encoding DNA sequences encompass sequences that comprise one or more additions, deletions, or substitutions of nucleotides when compared to a native or reference DNA sequence, but that encode a variant protein or fragment thereof that retains activity, e.g. ability to target a polypeptide for export via the curli export system. A wide variety of PCR-based site-specific mutagenesis approaches are also known in the art and can be applied by the ordinarily skilled artisan.

A variant amino acid or DNA sequence can be at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using freely available computer programs commonly employed for this purpose on the world wide web (e.g., BLASTp or BLASTn with default settings).

Alterations of the native amino acid sequence can be accomplished by any of a number of techniques known to one of skill in the art. Mutations can be introduced, for example, at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are very well established and include, for example, those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of the polypeptide also can be substituted, generally with serine, to improve the oxidative stability of the molecule and prevent aberrant crosslinking. Conversely, cysteine bond(s) can be added to the polypeptide to improve its stability or facilitate oligomerization.

Other than in the operating examples, or where otherwise indicated, all numbers expressing quantities of ingredients or reaction conditions used herein should be understood as modified in all instances by the term "about." The term "about" when used in connection with percentages can mean ±1%.

The articles "a" and "an," as used herein, should be understood to mean "at least one," unless clearly indicated to the contrary.

The phrase "and/or," when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

In one aspect, the present disclosure is directed to the use of a secretion system in a bacterium to secrete a non-native polypeptide from the bacterium and into the surrounding environment. The bacterium may be genetically-altered to include a heterologous encoding the nonnative polypeptide. In some embodiments, the non-native polypeptide is expressed and secreted from the bacterium using a bacterial secretion system which may be native to the bacterium or non-native to the bacterium. A bacterial secretion system which is nonnative to the bacterium is one which has been introduced into the bacterium, for example, through genetic modification of the bacterium to include nucleic acids encoding the non-native or foreign secretion system or components of a non-native secretion system. In some embodiments, the non-native polypeptide is expressed by the bacterium but not secreted from the bacterium.

In one aspect, the present invention provides an engineered bacterium comprising a heterologous nucleic acid encoding a recombinant silk protein, wherein the recombinant silk protein comprises a periplasmic translocation signal sequence, an outer membrane secretion signal sequence, and a silk fibroin domain. Without wishing to be bound by any particular theory, the expression of the recombinant silk proteins comprising said signal sequence provides for the robust production and secretion of silk proteins which may be readily purified and used for multiple applications.

In some embodiments, the heterologous nucleic acid encoding a recombinant silk protein comprises a heterologous nucleic acid encoding a periplasmic translocation signal sequence. In some embodiments, the periplasmic translocation signal sequence facilitates the export of the recombinant silk polypeptide from the cytoplasm of the bacterium to the periplasm of the bacterium via an endogenous or heterologous polypeptide secretion system. In some embodiments, the heterologous nucleic acid encoding a recombinant silk protein comprises multiple heterologous nucleic acid sequences encoding a periplasmic translocation signal sequence (e.g., one, two, three, four, five, or six nucleic acid sequences encoding a periplasmic translocation signal sequence). In some embodiments, the polypeptide secretion system that mediates the secretion of the polypeptide from the cytoplasm to the periplasmic space of the bacterium is a Sec system, a twin-arginine translocation (Tat) system, or a signal recognition particle (SRP) system. In some embodiments, the heterologous nucleic acid encoding recombinant silk protein encodes a periplasmic translocation signal sequence selected from the group consisting of a Sec signal sequence, a Tat signal sequence, and a SRP signal sequence. In some embodiments, the recombinant silk protein comprises a periplasmic translocation signal sequence. In some embodiments, the recombinant silk protein comprises a periplasmic translocation signal sequence selected from the group consisting of a Sec signal sequence, a Tat signal sequence, and a SRP signal sequence. In some embodiments, the recombinant silk protein comprises multiple periplasmic translocation signal sequences (e.g., one, two, three, four, five, or six periplasmic translocation signal sequences). In some embodiments, the periplasmic translocation sequence is N-terminal of the polypeptide. In some embodiments, the periplasmic translocation signal sequence is N-terminal of the outer membrane secretion signal sequence. In some embodiments, the periplasmic translocation sequence is C-terminal of the outer membrane secretion signal sequence. Other polypeptide secretion systems that mediate the transport (e.g., export) of polypeptides from the cytoplasm to the periplasmic space of the bacterium and their cognate signal peptides are known in the art and may be used as described herein (see, e.g., Green and Mecsas (2016) *Microbiol. Spectr.* 4:1; doi: 10.1128/microbiolspec.VMBF-0012-2015, the contents of which are incorporated herein by reference).

Bacterial secretion systems may be used to secrete a silk protein described herein (e.g., a silk protein comprising a silk fibroin domain) through a heterologous system evolved for the secretion of other proteins. Such secretions systems are known to those of skill in the art and include, for example: 1) systems for periplasmic secretion, and 2) systems for secretion from the periplasm, across the outer membrane, and into the extracellular milieu. An exemplary system for periplasmic secretion includes a Twin-arginine Translocation (Tat) system which exports fully folded proteins to the periplasm (see, e.g., Lee PA, Tullman-Ercek D, Georgiou G, "The bacterial twin-arginine translocation pathway", *Annu Rev Microbiol.* 60:373-95 (2006) PMID: 16756481, which is hereby incorporated by reference in its entirety). An exemplary system for periplasmic secretion includes a Signal Recognition Particle (SRP) system which mediates co-translational secretion into the periplasm (see. e.g., Saraogi I, Shan SO, "Co-translational protein targeting to the bacterial membrane", *Biochim. Biophys. Acta.* 1843 (8): 1433-41 (2014) doi: 10.1016/j.bbamcr.2013.10.013, PMID: 24513458, which is hereby incorporated by reference in its entirety).

The Sec system, also known as the Sec secretion pathway, primarily translocates proteins to the periplasmic space in their unfolded state (see, e.g., Beckwith (2013) *Res. Microbiol.* 164(6): 497-504). The Sec system consists of a protein targeting component, a motor protein and a membrane-integrated channel, called the SecYEG translocase complex, which is stably formed by the SecY, SecE and SecG proteins (encoded by the secY, secE and secG genes, respectively). SecB (encoded by the secB gene) is a chaperone protein that interacts with the nascent chain of the proteins preventing their folding. SecA (encoded by the secA gene) is an ATPase that interacts with SecB as well as the SecYEG translocase complex. Proteins not requiring SecB to prevent folding may be recognized by SecA and transferred during synthesis to the SecYEG translocase complex. SecA remains bound to SecYEG translocase complex as the protein is translocated and is released when the export is complete. Additional proteins that may be involved in the Sec system-mediated export of proteins from the cytoplasm to the periplasmic space include SecD and SecF (encoded by the secD and secF genes, respectively), which form the SecDF complex and may function as chaperone proteins, and YajC (encoded by the yajC gene) which co-purifies with the SecDF complex. The function of YajC is unclear.

In some embodiments, the bacterium comprises an endogenous Sec system. In some embodiments, the bacterium comprises an endogenous secY gene. In some embodiments, the bacterium comprises an endogenous secE gene. In some embodiments, the bacterium comprises an endogenous secG gene. In some embodiments, the bacterium comprises an endogenous secB gene. In some embodiments, the bacterium comprises an endogenous secA gene. In some embodiments, the bacterium comprises an endogenous secD gene. In some embodiments, the bacterium comprises an endogenous secF gene. In some embodiments, the bacterium comprises an endogenous yajC gene.

In some embodiments, the bacterium has been genetically-modified to comprise a heterologous Sec system. In some embodiments, the bacterium has been genetically-modified to comprise a heterologous secY gene. In some embodiments, the bacterium has been genetically-modified to comprise a heterologous secE gene. In some embodiments, the bacterium has been genetically-modified to comprise a heterologous secG gene. In some embodiments, the bacterium has been genetically-modified to comprise a heterologous secB gene. In some embodiments, the bacterium has been genetically-modified to comprise a heterologous secA gene. In some embodiments, the bacterium has been genetically-modified to comprise a heterologous secD gene. In some embodiments, the bacterium has been genetically-modified to comprise a heterologous secF gene. In some embodiments, the bacterium has been genetically-modified to comprise a heterologous yajC gene. In some embodiments, the bacterium has been genetically-modified to comprise one or more of a heterologous secY gene, a heterologous secE gene, a heterologous secG gene, a heterologous secB gene, a heterologous secA gene, a heterologous secD gene, a heterologous secF gene, and a heterologous yajC gene.

The twin arginine Tat system, also known as the Tat pathway, mediates the translocation of folded proteins across lipid bilayers, for example, from the cytoplasm to the periplasmic space (see, e.g., Robinson et al. (2011) *Biochimica et Biophysica Acta* 1808: 876-884; and Goosens et al. (2014) *Biochimica et Biophysica Acta* 1843: 1698-1706. Tat systems are present in both Gram-negative and Gram-positive bacteria. In *E. coli*, the Tat system is comprised of TatA, TatB and TatC subunits which mediate protein translocation, and are encoded by tatA, tatB and tatC genes. In *E coli*, an additional subunit TatE, encoded by the tatE gene partially complements tatA null mutants and appears to be redundant.

In some embodiments, the bacterium comprises an endogenous Tat system. In some embodiments, the bacterium comprises an endogenous tatA gene. In some embodiments, the bacterium comprises an endogenous tatB gene. In some embodiments, the bacterium comprises an endogenous tatC gene. In some embodiments, the bacterium comprises an endogenous tatE gene. In some embodiments, the bacterium comprises an endogenous tatABC operon.

In some embodiments, the bacterium has been genetically-modified to comprise a heterologous Tat system. In some embodiments, the bacterium has been genetically-modified to comprise a heterologous tatA gene. In some embodiments, the bacterium has been genetically-modified to comprise a heterologous tatB gene. In some embodiments, the bacterium has been genetically-modified to comprise a heterologous tatC gene. In some embodiments, the bacterium has been genetically-modified to comprise a heterologous tatE gene. In some embodiments, the bacterium has been genetically-modified to comprise a heterologous tatABC operon. In some embodiments, the bacterium has been genetically-modified to comprise one or more of a heterologous tatA gene, a heterologous tatB gene, a heterologous tatC gene, a heterologous tatE gene, and a heterologous tatABC operon.

The SRP pathway is a polypeptide transport system in bacterial cells which mediates the co-translational translocation of proteins through the inner membrane and into the periplasm. In the SRP system, a specific N-terminal protein sequence is recognized by a complex comprising, Ffh protein and a 4.5S RNA, which guides the nascent polypeptide chain directly into the periplasm via the FtsY receptor. In some embodiments, the SRP pathway signal sequence is cleavable (see, e.g., Schierle et al. (2003) J. Bacteriol. 185(19): 5706-13). Any known SRP pathway signal sequences can be used as described herein.

In some embodiments, the bacterium has been genetically-modified to comprise a heterologous ffh gene (which encodes Ffh protein). In some embodiments, the bacterium has been genetically-modified to comprise a heterologous ftsY gene (which encodes the signal recognition particle receptor protein FtsY). In some embodiments, the bacterium has been genetically engineered to comprise a heterologous ffs gene (which encodes 4.5S RNA). In some embodiments, the bacterium has been genetically-modified to comprise one or more of a heterologous ffh gene, a heterologous ftsY gene, and a heterologous ffs gene.

In some embodiments, the recombinant silk protein comprises a SRP signal sequence. In some embodiments, the heterologous nucleic acid encoding the recombinant silk protein comprises a SRP signal sequence selected from the group consisting of the SRP signal sequence comprises the signal sequence of a protein selected from the group consisting of TorT, SfmC, TraU, FocC, TreA, CcmH, FecB, YraI, TolB, AsmA, NikA, FlgI, DsbA, AppA, PcoE, BtuF, PapJ, YbcL, DsbC, ArtJ, ArtI, YraP, YcfS, FlgA, LivK, Agp, ModA, MalE, PhoA, LivJ, FepB, EcoT, MepA, AnsB, and Ivy, or homologs and/or variants, including conservative substitution variants, thereof.

In some embodiments, the recombinant silk protein comprises a periplasmic translocation signal sequence comprising an amino acid sequence as set forth in the sequence listing, or homologs and/or variants, including conservative substitution variants, thereof. In some embodiments, the heterologous nucleic acid encoding the recombinant silk protein comprises a periplasmic translocation signal sequence comprising an amino acid sequence as set forth in the sequence listing, or homologs and/or variants, including conservative substitution variants, thereof.

In some embodiments, the heterologous nucleic acid encoding the recombinant silk protein comprises a heterologous nucleic acid encoding an outer membrane secretion signal sequence. In some embodiments, the heterologous nucleic acid encoding a recombinant silk protein comprises multiple heterologous nucleic acid sequences encoding an outer membrane secretion signal sequence (e.g., one, two, three, four, five, or six nucleic acid sequences encoding an outer membrane secretion signal sequence). In some embodiments, the recombinant silk protein comprises an outer membrane secretion signal sequence. In some embodiments, the recombinant silk protein comprises multiple outer membrane secretion signal sequences (e.g., one, two, three, four, five, or six outer membrane secretion signal sequence).

In some embodiments, the outer membrane secretion signal sequence is N-terminal of the outer membrane secretion signal sequence. In some embodiments, the outer membrane secretion signal sequence is C-terminal of the periplasmic translocation signal sequence. The outer membrane signal sequence mediates the secretion of the protein through the outer membrane of the bacterium.

In some embodiments, the outer membrane signal sequence mediates the transport of the protein via a curli export system. In some embodiments, the outer membrane export signal sequence is a CsgGE export signal sequence, or homologs and/or variants, including conservative substitution variants, thereof. In some embodiments, the heterologous nucleic acid encoding the recombinant silk protein comprises a heterologous nucleic acid encoding a CsgGE export signal sequence, or homologs and/or variants, including conservative substitution variants, thereof. In some embodiments, the recombinant silk protein comprises a CsgGE export signal sequence, or homologs and/or variants, including conservative substitution variants, thereof. The CsgGE export signal sequence facilitates the transport of a polypeptide comprising the CsgGE export signal sequence from the bacterial periplasm via a bacterial type-8 secretion system. The Type-8 Secretion System (T8SS) of Gram-negative bacteria, such as *Escherichia coli*, is a dedicated protein export system that has evolved for the secretion of functional amyloids (e.g., an amyloid polypeptide) to the extracellular space. These amyloids then self-assemble to form nanofibers implicated in pathogenesis of epithelial tissue and biofilm persistence (Chapman et al. (2002) Science 295(5556): 851-855). The outer membrane porin for the T8SS is composed of nonameric outer membrane protein, CsgG. The fully assembled CsgG complex contains a 2 nm transmembrane channel (Goyal et al. (2014) Nature 516: 250-3). The structural monomeric unit of the functional amyloid, CsgA, is exported to the extracellular space via CsgG through a specific CsgG-specific N-terminal peptide tag, called N22. This event is preceded by translocation of the cytoplasmically-expressed CsgA protein to the periplasm through the Sec system, the major periplasmic export system in bacteria. An additional periplasmically-localized protein, CsgE, confers N22-containing substrate specificity for CsgG export and forms a multimeric complex with CsgG, encapsulating the protein to be exported and creating an entropic free-energy gradient that is thought to drive the export through the CsgG channel. In the absence of CsgE, the CsgG porin is ungated, allowing for passive diffusion of molecules through the outer membrane (Nenninger et al. (2011) Molecular Microbiology 81(2): 486-499).

In some embodiments, the CsgGE export signal sequence is an *E. coli* CsgGE export signal sequence. In some embodiments, the *E. coli* CsgGE export signal sequence comprises the amino acid sequence GVVPQYGGGG-NHGGGGNNSGPN (SEQ ID NO: 2030; referred to herein as N22).

Any CsgGE export signal sequence known in the art and homologs and/or variants, including conservative substitution variants, may be used as described herein. In some embodiments, the CsgGE export signal sequence comprises an amino acid sequence as set forth in the sequence listing, or homologs and/or variants, including conservative substitution variants, thereof. In some embodiments, the CsgGE export signal sequences comprises an amino acid sequence selected from the group consisting of GVVPQYGGGG-NHGGGGNNSGPN (SEQ ID NO: 2030), GVVPQWGGGGNHNGGGNSSGPD (SEQ ID NO: 2031), GVVPQYGGGNHGGGNGGGSNNSGPN (SEQ ID NO: 2032), GVVPQYGGGGNHGGGGN (SEQ ID NO: 2033), IPQYGGGNHGGGGNNSGPN (SEQ ID NO: 2034), IPQFGGGGHHGGGGNNSGPN (SEQ ID NO: 2035), GVVPQWGGGGNHNGGGNNSGPD (SEQ ID NO: 2036), IPQYGGGGGNHGGGGNNSGPN (SEQ ID NO: 2037), GAIPQYGGGGGGNHGGGGNNSGPN (SEQ ID NO: 2038), IPQYGGGGNHGGGGNNSGPN (SEQ ID NO: 2039), GVVPQYGGGNHGGGGNNSGPN (SEQ ID NO: 2040), GVVPQYGGGGNLGGGGNNSGPN (SEQ ID NO: 2041), GVVPQYGGGGNYGGGGNNSGPN (SEQ ID NO: 2042), GAVPQFGGGHGGGWGGGNNGPD (SEQ ID NO: 2043), GAIPQYGHGGGWGGGNSGPN (SEQ ID NO: 2044), IPQYGGGHGGGSNNGP (SEQ ID NO: 2045), GAVPQFGGHGHGHGGGGNSGPD (SEQ ID NO: 2046), GLVPQYGGGHGGGNTTGP (SEQ ID NO: 2047), GVVPQWGGNHHGGGNNYGPD (SEQ ID NO: 2048), GVVPQWGGSGHHNGGNNNGPD (SEQ ID NO: 2049), VPQYGNGGGHGGGSNGPN (SEQ ID NO: 2050), GLVPQYGGGHGGGGSTTGP (SEQ ID NO: 2051), VPQYGHGGNGGWGGNNGGPN (SEQ ID NO: 2052), GTVPQFGGGGGHNPGNGNNNGPN (SEQ ID NO: 2053), or homologs and/or variants, including conservative substitution variants, thereof. In addition, any export signal sequence that mediates the export of a polypeptide to the extracellular milieu that is orthologous to a curli export system may be used as described herein.

In some embodiments, the bacterium has been genetically-modified to comprise a heterologous csgE gene (which encodes CsgE). In some embodiments, the heterologous csgE gene is an *E. coli* csgE gene. In some embodiments, the bacterium has been genetically-engineered to comprise a heterologous csgG gene. In some embodiments, the heterologous csgE gene is an *E. coli* csgG gene (which encodes CsgG). In some embodiments, the bacterium has been genetically-modified to comprise a heterologous csgE gene and a heterologous csgG gene.

In some embodiments, the outer membrane signal sequence mediates the transport of the protein via a YebF export system. In some embodiments, the heterologous nucleic acid encoding the recombinant silk protein comprises a heterologous nucleic acid encoding a YebF signal sequence, or homologs and/or variants, including conservative substitution variants, thereof. In some embodiments, the recombinant silk protein comprises a YebF signal sequence, or homologs and/or variants, including conservative substitution variants, thereof. In some embodiments, the YebF signal sequence comprises the amino acid sequence as set forth in the sequence listing, or homologs and/or variants, including conservative substitution variants, thereof. The YebF export system mediates the secretion of a protein of interest by fusion to the YebF protein, which is secreted by *E. coli* (see, e.g., Zhang et al. (2006) *Nat. Biotechnol.* 24(1): 100-4; and Prehna et al. (2012) *Structure* 20(7): 1154-66, the contents of each which are hereby incorporated by reference in their entirety). The outer membrane proteins OmpC, OmpF, and OmpX (encoded by the ompC, ompF and ompX genes, respectively) mediate the outer membrane export of the YebF protein.

In some embodiments, the bacterium has been genetically-modified to comprise a heterologous ompC gene. In some embodiments, the bacterium has been genetically-engineered to comprise a heterologous ompF gene. In some embodiments, the bacterium has been genetically-modified to comprise a heterologous ompX gene. In some embodiments, the bacterium has been genetically-modified to comprise one or more of a heterologous ompC gene, a heterologous ompF gene, and a heterologous ompX gene.

Other exemplary system for secretion through the outer membrane includes the HlyA Type 1 secretion system (T1SS), which mediates secretion from the cytoplasm directly into the extracellular space via the hemolysin export system (see, e.g., Thomas et al., "The Type 1 secretion pathway—the hemolysin system and beyond", *Biochim Biophys Acta* 1843(8): 1629-41 (2014), doi:10.1016/j.bbamcr.2013.09.017, PMID:24129268, which is hereby incorporated by reference in its entirety).

In some embodiments, the heterologous nucleic acid encoding the recombinant silk protein comprises a heterologous nucleic acid encoding a silk fibroin domain. In some embodiments, the recombinant silk protein comprises a silk fibroin domain. A nonnative polypeptide within the scope of the present disclosure is spider silk. In some embodiments, the silk fibroin domain is a spider silk fibroin domain. Spider silk is composed of two major fibroin proteins, or 'spidroins', which are repetitive modular proteins of high molecular weight. The primary structure of the spidroin consists of ordered amino- and carboxy-terminal regions that flank a core domain rich in alanine and glycine residues. After secretion and spinning by the spider, the spider silk matures into a semicrystalline material wherein regions of self-assembled regularly ordered domains are embedded in an amorphous matrix. The ordered domains consist of antiparallel beta-sheet crystals that are encoded by poly-(Gly-Ala) and poly-Ala repeats. Confined hydrogen bonding networks between these crystalline beta-sheets are thought to underpin the unique mechanical properties of silk (see, e.g., Keten, S., Xu, Z., Ihle, B. & Buehler, M. J., "Nanoconfinement controls stiffness, strength and mechanical toughness of β-sheet crystals in silk", *Nat. Mater.* 9, 359-367 (2010); and Nova, A., Keten, S., Pugno, N. M., Redaelli, A. & Buehler, M. J., "Molecular and nanostructural mechanisms of deformation, strength and toughness of spider silk fibrils", *Nano Lett.* 10, 2626-34 (2010)).

In some embodiments, the heterologous nucleic acid encoding the recombinant silk protein comprises a heterologous nucleic acid encoding a 1 to 150 repeats of a silk fibroin domain. In some embodiments, the recombinant silk protein comprises a 1 to 150 repeats of a silk fibroin domain. In some embodiments, the heterologous nucleic acid encoding the recombinant silk protein comprises a heterologous nucleic acid encoding a 2 to 64 repeats of a silk fibroin domain. In some embodiments, the recombinant silk protein comprises a 2 to 64 repeats of a silk fibroin domain. In some embodiments, the recombinant silk protein comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 61, 63, 64, 65, 70, 75, 80, 85, 90, 95, 100, 105, 110, 115, 120, 125, 130, 135, 140, 145, or 150 silk fibroin domains. The combination of repeats of silk fibroin domain may comprise silk fibroin domains of the same type or of different types. In some embodiments, the silk fibroin domain is selected from the group consisting of a minor ampullate silk fibroin domain, an aggregate silk fibroin domain, a flagelliform (flag) silk fibroin domain, a tubulin silk fibroin domain, an aciniform silk fibroin domain and a piriform silk fibroin domain. In some embodiments, the silk fibroin domain comprises a consensus amino acid sequence as set forth in the sequence listing (see, e.g., Lewis (2006) *Chem. Rev.* 106(9): 3762-74, the entire contents of which are incorporated herein be reference). In some embodiments, the silk fibroin domain comprises the amino acid sequence GRGGLGGQGAGMAAAAAMGGAGQG-GYGGLGSQGTS (SEQ ID NO: 3).

In some embodiments, the silk fibroin domain comprises an amino acid sequence as set forth in NCBI Database Accession Numbers: AAT08436.1, ADM14316.1, ADM14324.1, ADM14315.1, ADM14325.1, OEH77770.1, GAP79055.1, AKJ27708.1, ABD66603.1, ABD66602.1, CAM32263.1, CAM32262.1, CAM32261.1, CAM32260.1, CAM32259.1, CAM32258.1, CAM32257.1, CAM32256.1, CAM32255.1, CAM32254.1, CAM32253.1, CAM32252.1, CAM32251.1, CAM32249.1, 2LTH_B, 2LTH_A, AGQ04592.1, CAM32272.1, ACC77633.1, 4FBS_A, 2LPJ_A, 2LPI_A, ABR68856.1, ABR68855.1, ACF19416.1, ACF19415.1, ACF19414.1, ACF19413.1, ACF19412.1, ACF19411.1, AAZ15372.1, AAZ15321.1, AEV46833.2, CAM32271.1, CAM32270.1, CAJ90517.1, AAZ15371.1, AAZ15320.1, AAZ15322.1, AAT75317.1, AAT75316.1, AAT75315.1, AAT75314.1, AAT75313.1, AAT75312.1, AAT75311.1, AAT75310.1, AAT75309.1, AAT75308.1, ADV40100.1, AD078764.1, ADM14319.1, ADM14314.1, ABY67415.1, ABY67411.1, ABY67405.1, ABY67403.1, ABY67401.1, AAY28936.1, AAY28935.1, AAK30615.1, AAK30614.1, AAK30609.1, AAK30608.1, AAK30607.1, AAK30606.1, AAK30604.1, AAK30601.1, AAK30596.1, AAK30592.1, ADE74592.1, AAK30602.1, AAK30595.1, CAJ00428.1, ABY67429.1, ABY67428.1, ABY67427.1, ABY67426.1, ABY67425.1, ABY67424.1, ABY67423.1, ABY67422.1, ABY67421.1, ABY67420.1, ABY67419.1, ABY67418.1, ABY67417.1, ABY67414.1, ABY67412.1, ABY67410.1, ABY67408.1, ABY67406.1, ABY67404.1, ABY67402.1, ABY67400.1, ABR68858.1, ABR68857.1, NP_001149975.2, ABD24295.1, ABD24294.1, AAT08435.1, AAT08434.1, AAT08433.1, AAT08432.1, CAM32269.1, CAM32268.1, CAM32267.1, CAM32266.1, CAM32265.1, CAM32264.1, AJM90221.1, XP_013227994.1, EGF91682.1, ABY67416.1, ABY67413.1, ABY67409.1, ABY67407.1, AAK30605.1, AAK30603.1, AAK30597.1, AAK30591.1, KYK63513.1, KYK63505.1, KYF45748.1, LAA03183.1, LAA04613.1, LAA08218.1, LAA09714.1, LAA10141.1, LAA12328.1, LAA15428.1, LAA16019.1, LAA15714.1, LAA16712.1, XP_013439532.1, XP_013337057.1, XP_013248467.1, CEL74577.1, CEL67190.1, CBZ53200.1, KFH04906.1, KFH04893.1, KFH00791.1, KFG64992.1, KFG53453.1, KFG53436.1, KFG50409.1, KFG31363.1, ESS28619.1, CDJ62170.1, CDJ53902.1, CDJ36084.1, CDJ60407.1, CDI75130.1, CDJ37156.1, CDI81984.1, AFW71573.1, AFP64859.1, EMD82476.1, XP_003883232.1, EGY00935.1, EGY00136.1, EGY00025.1, EGY00024.1, EGY00023.1, EGY00022.1, EGY00021.1, EGX99920.1, ACG37383.1, CAM32250.1, 2MX9_B, 2MX9_A, 2MX8_A, 2M0M_B, 2M0M_A, AFN54363.1, AFV31615.1, AAN85281.1, AAR13814.1, AAR13813.1, AAR13812.1, AAR13811.1, AAR13810.1, AAR13809.1, AAR13808.1, AAR13807.1, AAR13806.1, 2MFZ_B, 2MFZ_A, AGB35874.1, AFN54362.1, ADM14322.1, ADM14320.1, ACB29694.1, AFM29836.1, ADM14328.1, ADM14326.1, ADM14321.1, ADM14317.1, ABC72644.1, AAP88232.1, ABR37275.1, AAX30096.1, ADM14318.1, 5IZ2_Z, 5IZ2_A, 5IZ2_B, 2MAB_B, 2MAB_A, AHK09813.1, ACF71409.1, ACF71408.1, AAC04504.1, AAC14590.1, AAC14589.1, AMK48677.1, AMK48676.1, AMK48674.1, AAC04503.1, ACF71410.1, ACF71407.1, ADM35668.1, ADM14332.1, ADM14330.1, ABC72645.1, AAY28945.1, AAY28943.1, AAY28942.1, AAY28940.1, AAY28939.1, AAY28934.1, AAX45292.1, AAV48953.1, AAV48952.1, AAV48951.1, AAV48950.1, AAV48949.1, AAV48948.1, AAV48947.1, AAV48946.1, AAV48945.1, AAV48944.1, AAV48940.1, AAV48939.1, AAV48938.1, AAV48937.1, AAV48936.1, AAV48935.1, AAV48934.1, AAV48933.1, AAV48932.1, AAV48931.1, AAV48930.1, AAV48929.1, AAV48928.1, AAV48927.1, AAV48926.1, AAV48925.1, AAV48924.1, AAV48923.1, AAV48922.1, AAV48921.1, AAV48920.1, AAR83925.1, AAL32472.1, AAC38957.1, ABR37276.1, AFX83565.1, AFX83563.1, AFX83561.1, AFX83560.1, AFX83559.1, AFX83558.1, AHK09789.1, AHK09788.1, AHK09787.1, AHK09786.1, AHK09785.1, AHK09784.1, AHK09783.1, AHK09782.1, AHK09781.1, AHK09780.1, AHK09779.1, AHK09778.1, AHK09777.1, AHK09776.1, AHK09775.1, AHK09774.1, AHK09773.1, AHK09772.1, AHK09771.1, AHK09770.1, AHK09769.1, AHK09768.1, AHK09767.1, AHK09766.1, AHK09765.1, AHK09764.1, AHK09763.1, AFX83566.1, AFX83557.1, ABD24296.1, 3LR2_B, 3LR2_A, P19837.3, P46802.1, P46804.1, 3LRD_B, 3LRD_A, 3LR8_B, 3LR8_A, 3LR6_B, 3LR6_A, XP_015337966.1, XP_015926902.1, XP_015923885.1, XP_015915953.1, XP_015907747.1, XP_015907077.1, XP_015907076.1, XP_015907075.1, XP_015907074.1, XP_015907073.1, XP_015907072.1, XP_015907071.1, XP_015907070.1, XP_015907069.1, XP_015927451.1, AMF13980.1, AMF13979.1, XP_005329120.1, KFM79920.1, KFM79313.1, KFM74936.1, BAE86855.1, ADG57595.1, AAB60212.1, AAA17673.1, WP_018592840.1, AAC88554.1, AAC81918.1, AOH90403.1, ADM14313.1, ABW80568.1, ABW80567.1, ABW80566.1, ABW80565.1, ABW80563.1, ABD61600.1, ABD61599.1, ABD61597.1, ABD61596.1, ABD61594.1, ABD61593.1, ABD61592.1, ABD61591.1, ABD61590.1, ABD61589.1, ABD61588.1, AAL32375.1, ADG57596.1, ADG57593.1, AAA29380.2, ABR37274.1, AAK30613.1, AAK30611.1, AAK30600.1, AAK30599.1, 2N3E_A, XP_007493712.1, XP_007493711.1, XP_007493710.1, XP_015924996.1, XP_015910086.1, XP_015910083.1, XP_015910082.1, XP_015910081.1, XP_015910080.1, XP_015908848.1, KYK65898.1, CUJ63677.1, KYF39742.1, 10025810.1, XP_006470793.1, XP_015337967.1, ALM54786.1, WP_054444469.1, WP_046811332.1, KL017202.1, AJQ48468.1, KFM60634.1, EPT32613.1, EIW81425.1, CAJ20380.1, WP_043737320.1, AJN51722.1, AJN51680.1, AJN51679.1, AJL53619.1, AJL53618.1, AJL53617.1, AJL53507.1, KIL96307.1, KGH32759.1, AIU80193.1, AIU51173.1, BAP74122.1, KFH16126.1, KFH14329.1, KFH03307.1, KFG59505.1, KFG53981.1, KFG48063.1, KFG46978.1, KFG35613.1, KFG31970.1, WP_031207438.1, XP_007768770.1, AHH59767.1, ESS29295.1, ERL52248.1, CDF00959.1, CDE91356.1, EPR57584.1, AGP17343.1, WP_016418412.1, EPC00821.1, WP_008485474.1, AGH61341.1, AGH61340.1, AGH61339.1, AGH61338.1, AGH61337.1, AGH61336.1, AGH61335.1, AGH61334.1, AGH61333.1, AGH61332.1, AGH61331.1, AGH61330.1, AGH61329.1, AGH61328.1, AGH61327.1, AGF22332.1, AGF22331.1, AGF22330.1, AFX03498.1, 2KHM_B, 2KHM_A, EKE71000.1, AF002081.1, AF002080.1, ADG57597.1, AFM97627.1, AFM97625.1, AFM97623.1, AFM97621.1, AFM97619.1, AFM97618.1, AFM97617.1, AFM97616.1, AFM97615.1, AFL33148.1, ABW80562.1, AAC47011.1, AAC47010.1, AAC47009.1, AAC47008.1, AAA29381.1, AEQ78099.1, AEQ78098.1, AEQ44307.1, AEQ44306.1, AEQ44305.1, AEH19948.1, AEH19947.1, AEH19946.1, ADS13223.1, ADS13222.1, ADS13221.1, ACR88286.1, ACR88284.1, ACR88282.1, ACR88281.1, ACR88277.1, ACR88276.1, ACR88274.1, ACR88272.1, ACR88270.1, ACR88269.1, ACR88268.1, ACR88267.1, ACR88266.1, ACR88265.1, ACR88264.1, ACR88263.1, BAE86856.1, AAE50748.1, 1589022, 1589021, BAE51681.1, AOH90437.1, AOH90431.1, NP_628424.1, ACI23395.1, ADH65296.1, ADH65027.1, AAC38846.1, AAF36091.1, XP_015928803.1, XP_015926099.1, XP_015926098.1, XP_015925523.1, XP_015922043.1, XP_015918918.1, XP_015913485.1, XP_015912961.1, XP_015912814.1, XP_015664484.1, XP_015664483.1, AMF14002.1, AMF14001.1, AMF13994.1, AMF13992.1, AMF13991.1, AMF13990.1, CUW39853.1, KPA86045.1, KPA86044.1, BAS78900.1, XP_013416068.1, WP_052004167.1, ADR37091.1, ENH87197.1, KFM79464.1, KFM73910.1, KFM70693.1, KFM62633.1, KFM62627.1, KFM61802.1, KFM61798.1, KFM59473.1, KFM57717.1, EPE04573.1, CAB77344.1, ADU51385.1, ADU51096.1, ADU50755.1, ADU50701.1, ADU50272.1, WP_028670286.1, AHL56647.1, ADK84021.1, WP_010403048.1, WP_011385254.1, AFX83556.1, EME70738.1, 2K3Q_A, AAR21194.1, AAX83289.1, XP_002462408.1, BAE54451.1, CAJ90517.1, AAC38846.1, AAF36091.1, AEQ78099.1, AEQ78098.1, ADH65317.1, ADH65186.1, EFP05295.1, XP_003113957.1, AFV31615.1, AFM29836.1, ADM14322.1, ADM14320.1, ADM14328.1, ADM14326.1, ADM14321.1, AFV31614.1, AFV31613.1, AFM29835.1, ADM14329.1, ADM14327.1, LAA15038.1, 2M0M_B, 2M0M_A, 2MX9_B, 2MX9_A, 2MX8_A, 2MFZ_B, 2MFZ_A, ACB29694.1, AAC14590.1, AAC14589.1, ABC72645.1, ABR37276.1, 2MAB_B, 2MA_A, ADG57595.1, AAC88554.1, AAC81918.1, AMK48677.1, AMK48676.1, AMK48674.1, AMK48679.1, AMK48678.1, AMK48675.1, AMK48658.1, AMK48673.1, AMK48672.1, AMK48671.1, AMK48670.1, AMK48669.1, AMK48668.1, AMK48667.1, AMK48666.1, AMK48665.1, AMK48664.1, AMK48663.1, AMK48662.1, AMK48661.1, AMK48660.1, AMK48659.1, AFP57565.1, AFP57562.1, AFP57559.1, AAX45292.1, AAX45295.1, AAX45293.1, AAX45291.1, ANU43172.1, KOA64249.1, KOA59653.1, KOA54241.1, KOA52153.1, KOA48308.1, KOA44837.1, KOA44098.1, AJD89173.1, AJC77129.1, AGW85645.1, KFI80719.1, KFI77799.1, KFI56933.1, KFI41035.1, AIA33447.1, ACL28956.1, EHN17524.1, AAY28931.1, AAY28934.1, AAY28933.1, AAY28932.1, ADM14332.1, ADM14323.1, AAY28945.1, AAY28943.1, AAY28942.1, AAY28940.1, AAY28939.1, ADM14333.1, ADM14331.1, ADM14330.1, ABD24296.1, AAX45294.1, ADV40185.1, AAY28954.1, AAY28952.1, AAY28951.1, AAY28950.1, AAY28949.1, AAY28948.1, AAY28947.1, AAY28946.1, AAY28944.1, AAY28941.1, AAY28938.1, AAY28937.1, KFI66148.1, CDL70925.1, AFA43480.1, AAY28953.1, AFX83557.1, AAY28936.1, AAY28935.1, ABR68858.1, ABR68857.1, ABR37274.1, AFX83565.1, AFX83563.1, AFX83561.1, AFX83560.1, AFX83559.1, AFX83558.1, 2LYI_A, ABW24499.1, AFX83568.1, AFX83567.1, AFX83564.1, AFX83562.1, KFM79920.1, BAE86856.1, BAE86855.1, ABW80568.1, KFM62627.1, XP_015924996.1, XP_015907747.1, ABW80566.1, ABC72645.1, BAE54451.1, ABD61589.1, ABC72644.1, AAC14589.1, AAK30600.1, ACR88282.1, ACI23395.1, KFM70693.1, KFM62633.1, 2MAB_B, 2MAB_A, AAR83925.1, AHK09813.1, ADM35668.1, AFX83565.1, AFX83563.1, AFX83561.1, AFX83560.1, AFX83559.1, AFX83558.1, 2LYI_A, ABW24499.1, AHK09789.1, AHK09788.1, AHK09787.1, AHK09786.1, AHK09785.1, AHK09784.1, AHK09783.1, AHK09782.1, AHK09781.1, AHK09780.1, AHK09779.1, AHK09778.1, AHK09777.1, AHK09776.1, AHK09775.1, AHK09774.1, AHK09773.1, AHK09772.1, AHK09771.1, AHK09770.1, AHK09769.1, AHK09768.1, AHK09767.1, AHK09766.1, AHK09765.1, AHK09764.1, AHK09763.1, AFX83566.1, AFX83557.1, ADM35669.1, LAA01884.1, LAA09345.1, LAA09348.1, LAA15662.1, LAA16773.1, AHK09812.1, AHK09811.1, AHK09810.1, AHK09809.1, AHK09808.1, AHK09807.1, AHK09806.1, AHK09805.1, AHK09804.1, AHK09803.1, AHK09802.1, AHK09801.1, AHK09800.1, AHK09799.1, AHK09798.1, AHK09797.1, AHK09796.1, AHK09795.1, AHK09794.1, AHK09793.1, AFX83568.1, AFX83567.1, AFX83564.1, AFX83562.1, 2MU3_A, 307159084, 818905455, 347811351, 307159086, 307159082, and 301078347, the amino acid sequences corresponding to each accession number which are incorporated herein by reference.

In some embodiments, the silk fibroin domain comprises a minor ampullate silk fibroin domain. In some embodiments, the minor ampullate silk fibroin domain comprises an amino acid sequence as set forth in NCBI Database Accession Numbers: AAC14589.1, AAC14590.1, AAC14591.1, A0034847.1, A0034825.1, ACI63001.1, AIT41471.1, AGX00072.1, AGX00067.1, AGX00064.1, AGX00062.1, AGP47431.1, AGP47492.1, AG088936.1, AG088929.1, AG088926.1, AG088855.1, AG088848.1, AG088845.1, AAK62518.1, CUU33208.1, CUI09422.1, AJR18647.1, YP_008166902.1, YP_008161883.1, CTQ89448.1, CEL20537.1, YP_009062955.1, YP_009062950.1, YP_009062947.1, YP_009062945.1, YP_009023249.1, YP_009023242.1, YP_009023239.1, YP_009023168.1, YP_009023161.1, YP_009023158.1, NP_862422.1, YP_008145026.1, YP_002286943.1, CEF90318.1, CDF32058.1, 2MX9_B, 2MX9_A, 2MX8_A, 2M0M_B, 2M0M_A, 2MFZ_B, 2MFZ_A, ACB29694.1, AFV31615.1, ABC72645.1, ABR37276.1, ABR37278.1, ADM14328.1, ADM14326.1, ADM14321.1, ABR37277.1, ADM14322.1, ADM14320.1, ADM14329.1, ADM14327.1, 2MAB_B, 2MAB_A, ADG57595.1, AAC88554.1, AAC81918.1, 2MQA_A, AAC88595.1, AAC88594.1, AAC88593.1, AAC88592.1, AAC88591.1, AAC88590.1, AAC88589.1, AAC88588.1, AAC88587.1, AAC88586.1, AAC88585.1, AAC88584.1, AAC88583.1, AAC88582.1, AAC88581.1, AAC88580.1, AAC88579.1, AAC88578.1, AAC88577.1, AAC88576.1, AAC88575.1, AAC88574.1, AAC88573.1, AAC88572.1, AAC88571.1, AAC88570.1, AAC88569.1, AAC88568.1, AAC88567.1, AAC88566.1, AAC88565.1, AAC88564.1, AAC88563.1, AAC88562.1, AAC88561.1, AAC88560.1, AAC88559.1, AAC88558.1, AAC88557.1, AAC88556.1, AAC88555.1, AAC88553.1, AAC88552.1, AAC88551.1, AAC81959.1, AAC81958.1, AAC81957.1, AAC81956.1, AAC81955.1, AAC81954.1, AAC81953.1, AAC81952.1, AAC81951.1, AAC81950.1, AAC81949.1, AAC81948.1, AAC81947.1, AAC81946.1, AAC81945.1, AAC81944.1, AAC81943.1, AAC81942.1, AAC81941.1, AAC81940.1, AAC81939.1, AAC81938.1, AAC81937.1, AAC81936.1, AAC81935.1, AAC81934.1, AAC81933.1, AAC81932.1, AAC81931.1, AAC81930.1, AAC81929.1, AAC81928.1, AAC81927.1, AAC81926.1, AAC81925.1, AAC81924.1, AAC81923.1, AAC81922.1, AAC81921.1, AAC81920.1, AAC81919.1, AAC81917.1, AAC81916.1, and AAC81915.1, the amino acid sequences corresponding to each accession number which are incorporated herein by reference.

In some embodiments, the silk fibroin domain comprises an aggregate silk fibroin domain. In some embodiments, the aggregate silk fibroin domain comprises an amino acid sequence as set forth in NCBI Database Accession Numbers: AMK48658.1, AMK48673.1, AMK48672.1, AMK48671.1, AMK48670.1, AMK48669.1, AMK48668.1, AMK48667.1, AMK48666.1, AMK48665.1, AMK48664.1, AMK48663.1, AMK48662.1, AMK48661.1, AMK48660.1, AMK48659.1, AFP57565.1, AFP57562.1, AMK48679.1, AMK48678.1, AMK48677.1, AMK48676.1, AMK48675.1, and AMK48674.1, the amino acid sequences corresponding to each accession number which are incorporated herein by reference.

In some embodiments, the silk fibroin domain comprises a flagelliform (flag) silk fibroin domain. In some embodiments, the flagelliform (flag) silk fibroin domain comprises an amino acid sequence as set forth in NCBI Database Accession Numbers: AAC38846.1, AAT36347.1, AAC38847.1, AAF36091.1, AAK30594.1, AAK30593.1, AAF36092.1, AAF36090.1, AAF36089.1, EEC09351.1, EEC05390.1, ADN23579.1, ADN23577.1, KUG05367.1, AIY48668.1, CTQ93180.1, CRK58766.1, CRK58764.1, AJW39886.1, BAQ62602.1, KKW05526.1, EEC20124.1, EAX93621.1, CEL23644.1, KIG11542.1, EWC62749.1, EUA21042.1, EJI95902.1, XP_002433990.1, XP_002400080.1, XP_002401328.1, XP_001306551.1, BAC99451.1, ABR37273.1, ABK00016.1, CAJ90517.1, ADH65223.1, ADH65221.1, ADH65090.1, ADH65055.1, ADH65034.1, BAS78003.1, ADV61483.1, AEB08848.1, ADU52289.1, ADU51393.1, BAF18870.1, BAF08409.1, BAG95178.1, and CAB87946.1, the amino acid sequences corresponding to each accession number which are incorporated herein by reference.

In some embodiments, the silk fibroin domain is a tubulin silk fibroin domain. In some embodiments, the tubulin silk fibroin domain comprises an amino acid sequence as set forth in NCBI Database Accession Numbers: JAR06716.1, BAE86856.1, BAE86855.1, AAY28931.1, 2K3O_A, 2K3N_A, AAY28933.1, AAY28932.1, BAE54450.1, AAY28934.1, AAX45295.1, AAX45293.1, AAX45291.1, BAE54451.1, ABR37274.1, ACI23395.1, ADM14323.1, ABD24296.1, ADM14332.1, AAX45292.1, AAC14589.1, ADV40185.1, ADM14333.1, ADM14331.1, AAY28954.1, AAY28952.1, AAY28951.1, AAY28950.1, AAY28949.1, AAY28948.1, AAY28947.1, AAY28946.1, AAY28945.1, AAY28944.1, AAY28943.1, AAY28942.1, AAY28941.1, AAY28940.1, AAY28939.1, AAY28938.1, AAY28937.1, ADM14330.1, AAX45294.1, AFA43480.1, AAY28953.1, KFM79920.1, AFX83557.1, AGR65217.1, WP_020843129.1, AFM97620.1, ABW80568.1, KFM62627.1, AAZ15706.1, AAK30612.1, ACR88285.1, ABD61598.1, AAY90151.1, ABR68858.1, ABR68857.1, ABW80564.1, AAY28936.1, AAY28935.1, ABD61589.1, XP_015924996.1, KXT76149.1, ABW80566.1, ABC72645.1, ABN13925.1, XP_015907747.1, ABR37278.1, CUR40212.1, KTF81708.1, XP_014025605.1, XP_014025604.1, XP_014025602.1, ABW24499.1, ADV40181.1, ABC72644.1, AAK30600.1, KFM70693.1, KFM62633.1, AHK09791.1, AFX83568.1, AFX83567.1, AFX83565.1, AFX83564.1, AFX83563.1, AFX83562.1, AFX83561.1, AFX83560.1, AFX83559.1, AFX83558.1, ACR88282.1, EOY18426.1, ADU23756.1, EAQ83169.1, ACV03419.1, EDW00619.1, KZN71099.1, WP_062906493.1, WP_062896115.1, ALU60113.1, XP_006990705.2, KXZ53453.1, KXT17944.1, KXT08739.1, XP_015495616.1, XP_015472967.1, XP_015472966.1, XP_015472964.1, XP_015472963.1, XP_015472962.1, XP_015472961.1, CUR39570.1, XP_015338007.1, XP_015338006.1, GAC97239.1, XP_002000489.1, CUU27780.1, XP_014781761.1, XP_014773071.1, XP_014794002.1, XP_014794001.1, XP_014794000.1, XP_014726746.1, XP_014726745.1, XP_014726744.1, WP_011723794.1, CUI03994.1, WP_057406778.1, EDW15950.1, KPX62564.1, XP_008545413.1, KPI97631.1, WP_054263331.1, XP_014167486.1, XP_014116011.1, XP_014122317.1, XP_014122316.1, XP_014112343.1, XP_014030156.1, XP_014030155.1, XP_014030153.1, XP_014025603.1, XP_014054492.1, XP_013676349.1, KOF87513.1, KOF87511.1, WP_050780405.1, WP_042229582.1, WP_051870755.1, WP_051863026.1, WP_051861131.1, KEQ92117.1, XP_013340518.1, XP_013227263.1, XP_013227262.1, XP_013227261.1, XP_013153866.1, XP_005463415.1, CRH97187.1, XP_013034801.1, XP_012994535.1, XP_012994534.1, XP_012994533.1, XP_012994532.1, XP_012950187.1, XP_012950183.1, 2MQA_A, XP_012670522.1, AKI80407.1, WP_046357626.1, KKE81922.1, XP_012190826.1, KFM77639.1, EKX40791.1, EGX96200.1, XP_011413944.1, CEK40236.1, XP_011315453.1, JAG80700.1, KIM38534.1, CAQ41616.1, WP_036204683.1, KHN36369.1, CCQ38052.1, XP_010005229.1, CDY50596.1, CDG98384.1, CDH00697.1, CDH18149.1, WP_030453286.1, KEQ48985.1, CDP19197.1, WP_026128052.1, WP_024859189.1, AGR65376.1, XP_007910174.1, XP_007905153.1, YP_008873468.1, EYB28497.1, AGI11726.1, XP_006818343.1, XP_006807688.1, XP_006807687.1, XP_006807686.1, ABK65722.1, XP_006666077.1, XP_005827771.1, WP_021434916.1, EQK53805.1, WP_018500291.1, WP_010166019.1, WP_015410778.1, WP_013483306.1, 2LYI_A, YP_001426738.1, XP_001985752.1, EFA85813.1, XP_002260349.1, XP_001613854.1, XP_001226254.1, ABT16391.1, and EDL44127.1, the amino acid sequences corresponding to each accession number which are incorporated herein by reference.

In some embodiments, the silk fibroin domain is an aciniform silk fibroin domain. In some embodiments, the aciniform silk fibroin domain comprises an amino acid sequence as set forth in NCBI Database Accession Numbers: AFX83557.1, 2MU3_A, 2MAB_B, 2MAB_A, ABW24499.1, AAR83925.1, AHK09813.1, AHK09791.1, AHK09789.1, AHK09788.1, AHK09787.1, AHK09786.1, AHK09785.1, AHK09784.1, AHK09783.1, AHK09782.1, AHK09781.1, AHK09780.1, AHK09779.1, AHK09778.1, AHK09777.1, AHK09776.1, AHK09775.1, AHK09774.1, AHK09773.1, AHK09772.1, AHK09771.1, AHK09770.1, AHK09769.1, AHK09768.1, AHK09767.1, AHK09766.1, AHK09765.1, AHK09764.1, AHK09763.1, AFX83568.1, AFX83567.1, AFX83566.1, AFX83565.1, AFX83564.1, AFX83563.1, AFX83562.1, AFX83561.1, AFX83560.1, AFX83559.1, AFX83558.1, 2LYI_A, AHK09812.1, AHK09811.1, AHK09810.1, AHK09809.1, AHK09808.1, AHK09807.1, AHK09806.1, AHK09805.1, AHK09804.1, AHK09803.1, AHK09802.1, AHK09801.1, AHK09800.1, AHK09799.1, AHK09798.1, AHK09797.1, AHK09796.1, AHK09795.1, AHK09794.1, AHK09793.1, AHK09792.1, and AHK09790.1, the amino acid sequences corresponding to each accession number which are incorporated herein by reference.

In some embodiments, the silk fibroin domain is a piriform silk fibroin domain. In some embodiments, the piriform silk fibroin domain comprises an amino acid sequence as set forth in NCBI Database Accession Numbers: AEP25627.1, ADN39427.1, ADN39425.1, ADN39426.1, and ADK56477.1, the amino acid sequences corresponding to each accession number which are incorporated herein by reference.

Methods of the present invention use the curli fiber production systems of a bacterium, such as *E. coli* to produce curli fibers formed using recombinant silk proteins described herein that comprise an amyloid domain (e.g., CsgA) Curli fibers are the primary proteinaceous structural component of *E. coli* biofilms. They are highly robust functional amyloid nanofibers with a diameter of approximately 4-7 nm that exist as extended tangled networks encapsulating the cells. Curli fibers or curli are formed from the extracellular self-assembly of CsgA, a small secreted 13-kDa protein (see, e.g., Chapman, M. R. et al. Role of *Escherichia coli* curli operons in directing amyloid fiber formation. *Science* 295, 851-855 (2002)). A homologous outer-membrane protein, CsgB, nucleates CsgA assembly and also anchors the nanofibers to the bacterial surface. Detached curli fibers can also exist as non-cell associated structural components of the extracellular matrix (ECM). The curli genes exist as two divergently transcribed operons (csgBAC and csgDEFG), whose seven products mediate the structure (CsgA), nucleation (CsgB), processing (CsgE, F), secretion (CsgC, G), and direct transcriptional regulation (CsgD) of curli nanofibers. This curli secretion system is considered a distinct secretion system of its own in gram-negative bacterium and is named the Type-VIII secretion system (T8SS) (see, e.g., Desvaux et al., *Trends Microbiol.* 17, 139-45 (2009), which is hereby incorporated by reference in its entirety). Thus, in some embodiments, the heterologous nucleic acid encoding a recombinant silk protein further comprises a heterologous nucleic acid encoding an amyloid domain. In some embodiments, the recombinant silk protein further comprises an amyloid domain. In some embodiments, the amyloid domain comprises CsgA.

Aspects of the present disclosure are directed to the use of a secretion system, such as a T8SS secretion system, to export a recombinant silk polypeptide disclosed herein, such as a recombinant silk protein comprising a spider silk fibroin domain, from within a bacterium (such as a gram-negative or gram-positive bacterium) and into the surrounding environment. According to one aspect, the recombinant silk protein is an amyloid-silk hybrid, for example, comprises a silk fibroin domain connected (i.e., fused) to an amyloid domain (e.g., CsgA). According to this aspect, the recombinant silk protein is secreted into the extracellular space or milieu of the bacterium. The secreted recombinant silk protein can then be collected and purified. According to one aspect, the recombinant silk protein can comprise one or more of an amyloid, elastin, or collagen domains to alter the physical and mechanical properties of the resulting material as compared to a recombinant silk protein that does not comprise an amyloid, elastin, or collagen domain.

In one aspect, provided herein is an engineered bacterium comprising a heterologous nucleic acid sequence encoding a recombinant silk protein, wherein the recombinant silk protein comprises a periplasmic translocation signal sequence, an outer membrane secretion signal sequence, a silk fibroin domain and one or more of an amyloid domain, an elastin domain or a collagen domain. In some embodiments, the amyloid domain is CsgA.

In another aspect, provided herein is a nucleic acid sequence encoding a recombinant silk protein described herein. In one embodiment, provided herein is a nucleic acid sequence encoding a recombinant silk protein, wherein the recombinant silk protein comprises a periplasmic translocation signal sequence, an outer membrane secretion signal sequence, a silk fibroin domain and one or more of an amyloid domain, an elastin domain or a collagen domain. In some embodiments, the amyloid domain is CsgA.

In yet another aspect, provided herein is a recombinant silk protein comprising a periplasmic translocation signal sequence, an outer membrane secretion signal sequence, a silk fibroin domain and one or more of an amyloid domain, an elastin domain or a collagen domain. In some embodiments, the periplasmic translocation signal sequence and/or the outer membrane secretion signal sequence is cleaved-off the recombinant silk protein within the cell. In some embodiments, the amyloid domain is CsgA.

As used herein, "CsgA" refers to the major structural subunit of curli. The sequences of CsgA and its homologs are known in a number of species, e.g., the sequence of *E. coli* CsgA is known (NCBI Gene ID NO: 949055; (SEQ ID NO: 4) (polypeptide)).

```
CsgA polypeptide (NCBI Ref Seq: NP 415560)
                                                    (SEQ ID NO: 4)
    1  mkllkvaaia aivfsgsala gvvpqygggg nhggggnnsg pnselniyqy gggnsalalq 61  tdarnsdlti tqhgggngad vgqgsddssi dltqrgfgns atldqwngkn semtvkqfgg 121  gngaavdqta snssvnvtqv gfgnnatahq y.
```

In some embodiments, "CsgA" refers to an *E. coli* CsgA. In some embodiments, "CsgA" refers to a polypeptide having at least 80% homology to SEQ ID NO: 4 (e.g., 80% or greater homology, 90% or greater homology, or 95% or greater homology), e.g. naturally occurring mutations or variants of CsgA, homologs of CsgA, or engineered mutations or variants of CsgA. In some embodiments, CsgA refers to a polypeptide comprising an amino acid sequence having at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of SEQ ID NO: 4. The silk fibroin domain may be directly connected to the CsgA polypeptide or be connected via a linker at either the C-terminus or the N-terminus or both of the CsgA, but without interrupting the sequence of the CsgA polypeptide. CsgA within the scope of the present disclosure includes an amyloid domain which self-assembles into an amyloid structure. According to certain aspects, a linker may be attached to either the C-terminus or the N-terminus or separate linkers may be attached to both the C terminus and the N terminus of the CsgA.

According to one aspect, self-assembling protein domains, such as CsgA, are used to generate the similar self-assembling characteristics for artificial silk fusion proteins. A factor in the maturation of spider silk in spiders is the self-assembly of N- and C-terminal domains intiated by changes in pH and ionic strength (see, e.g., Gronau et al. (2013) *Biomater. Sci.* 1(3): 276-84; Hagn et al. (2010) *Nature* 465(7295): 239-42; Schwarze et al. (2013) *Nat. Commun.* 4: 2815). These changes in the spider's silk glands lead to the step-wise assembly of the silk proteins from a stored nematic liquid to a super strong biofilament. Replicating this assembly of the silk proteins into a strong fiber has been a key step towards replicating the amazing physical properties of spider silk. According to the present disclosure, the pH/salt driven assembly of the N- and C-terminal domains is replaced with other self-assembling protein domains, such as CsgA, to generate the similar self-assembling characteristics for artificial silk fusion proteins.

According to one aspect, engineered bacteria are modified to comprise a heterologous nucleic acid encoding the recombinant silk protein described herein (e.g., a recombinant silk protein comprising an amyloid domain such as CsgA). In some embodiments, the recombinant silk protein comprises an elastin domain or a collagen domain. Useful sequences and structures for elastin domains and collagen domains are known to those of skill in the art, such as VPVXG (SEQ ID NO: 5) which is an exemplary elastin domain.

The polypeptide, such as spider silk, may also be connected to a domain which guides the polypeptide to the periplasm and/or a domain which guides the polypeptide outside of the bacterium through the outer cell wall. Methods of introducing a nucleic acid to a bacteria cell are known to those of skill in the art. In some embodiments, the engineered bacterium is modified to comprise a heterologous nucleic acid encoding a recombinant silk protein described herein, wherein the heterologous nucleic acid is located in the bacterial chromosome. In some embodiments, the engineered bacterium is modified to comprise a heterologous nucleic acid encoding a recombinant silk protein described herein, wherein the heterologous nucleic acid is located in a plasmid.

According to one aspect, the engineered bacteria secrete the recombinant silk protein, such that the protein is free for collection and purification. According to one aspect, the modified bacteria secrete the recombinant silk protein resulting in curli fiber production. In another aspect, biofilms comprising the recombinant silk protein described herein, or an engineered bacteria described herein are provided.

In some embodiments, the recombinant silk protein (e.g., recombinant spider silk or recombinant CsgA-spider silk fusion) may be produced by engineered or non-naturally occurring bacteria. According to one aspect, methods are provided for engineering a bacteria to produce a recombinant silk protein (e.g., a recombinant silk protein not comprising an amyloid domain or a recombinant silk protein comprising an amyloid domain) which may be exported from the bacterium. The recombinant silk protein comprising an amyloid domain (e.g., CsgA, which is also referred to herein as a CsgA-spider silk fusion protein) may be exported from the bacterium and assemble into extracellular amyloid fibers. After secretion, the CsgA-spider silk fusion protein may nucleated to form an amyloid at the cell surface, polymerize into long fibers, and optionally, eventually encapsulate the bacterium, and provide a biofilm with structural support. In some embodiments, provided herein are biofilms comprising an engineered bacterium as described herein.

CsgA within the scope of the present disclosure includes an amyloid domain which self-assembles into an amyloid structure. According to certain aspects, a linker may be attached to either the C terminus or the N-terminus or separate linkers may be attached to both the C terminus and the N terminus.

Aspects of the present disclosure are directed to a method of producing a genetically modified bacterium including genetically altering a bacterium having one or more genomic nucleic acids encoding a polypeptide secretion system to include an exogenous nucleic acid encoding a recombinant protein including a domain for periplasmic localization, a domain for directing the recombinant protein to the outer membrane for secretion and one or more silk fibroin domains, wherein the exogenous nucleic acid is under operation of a promoter to express the recombinant protein. According to one aspect, the polypeptide secretion system is a Type VIII secretion system or a HlyA Type 1 secretion system. According to one aspect, the polypeptide secretion system includes a periplasmic secretion system and a system for secretion through the outer membrane of the bacterium. According to one aspect, the polypeptide secretion system includes a periplasmic secretion system and a system for secretion through the outer membrane of the bacterium and wherein the periplasmic secretion system is a Sec system. According to one aspect, the polypeptide secretion system includes a periplasmic secretion system and a system for secretion through the outer membrane of the bacterium and wherein the periplasmic secretion system is a twin-arginine translocation (Tat) system. According to one aspect, the polypeptide secretion system includes a periplasmic secretion system and a system for secretion through the outer membrane of the bacterium and wherein the periplasmic secretion system is a signal recognition particle (SRP) system. According to one aspect, the polypeptide secretion system includes a periplasmic secretion system and a system for secretion through the outer membrane of the bacterium and a domain for periplasmic localization is a Sec domain or a Tat domain or a signal recognition particle domain. According to one aspect, the polypeptide secretion system includes a periplasmic secretion system and a system for secretion through the outer membrane of the bacterium and a domain for periplasmic localization is a component of a Sec system, a component of a Tat system or a component of a signal recognition particle system. According to one aspect, the polypeptide secretion system includes a periplasmic secretion system and a system for secretion through the outer membrane of the bacterium and wherein the system for secretion through the outer membrane of the bacterium is a N22 system. According to one aspect, the polypeptide secretion system includes a periplasmic secretion system and a system for secretion through the outer membrane of the bacterium and wherein the system for secretion through the outer membrane of the bacterium is a YebF system. According to one aspect, the polypeptide secretion system includes a periplasmic secretion system and a system for secretion through the outer membrane of the bacterium and wherein a domain for directing the recombinant protein to the outer membrane for secretion is an N22 domain or a YebF domain. According to one aspect, the exogenous nucleic acid further encodes the recombinant protein to include one or more of an amyloid domain, an elastin domain or a collagen domain. According to one aspect, the exogenous nucleic acid further encodes the recombinant protein to include a CsgA domain. According to one aspect, the bacterium is E. coli. According to one aspect, the bacterium is non-pathogenic. According to one aspect, the silk fibrin domain includes the amino acid sequence GRGGLGGQGAGMAAAAAMGGAGQGGYGGLGSQGTS (SEQ ID NO:3). According to one aspect, the silk fibrin domain includes 4 to 64 repeats of the amino acid sequence (SEQ ID NO: 3)
GRGGLGGQGAGMAAAAAMGGAGQGGYGGLGSQGTS.

Aspects of the present disclosure are directed to a method for producing one or more silk fibroin domains from a genetically modified bacterium including providing the genetically modified bacterium in culture media conditions, wherein the genetically modified bacterium includes one or more genomic nucleic acids encoding a polypeptide secretion system and further including an exogenous nucleic acid encoding a recombinant protein including a domain for periplasmic localization, a domain for directing the recombinant protein to the outer membrane for secretion and the one or more silk fibroin domains, wherein the exogenous nucleic acid is under operation of a promoter to express the recombinant protein, and expressing the exogenous nucleic acid to produce the recombinant protein wherein the recombinant protein is secreted from the bacterium and into the surrounding culture media. According to one aspect, the method further provides proliferating the bacterium to produce a population of bacteria cells expressing the exogenous nucleic acid. According to one aspect, the method further provides proliferating the bacterium to produce a population of bacteria cells expressing the exogenous nucleic acid to form a biofilm including the recombinant protein. According to one aspect, the polypeptide secretion system is a Type VIII secretion system or a HlyA Type 1 secretion system. According to one aspect, the polypeptide secretion system includes a periplasmic secretion system and a system for secretion through the outer membrane of the bacterium. According to one aspect, the polypeptide secretion system includes a periplasmic secretion system and a system for secretion through the outer membrane of the bacterium and wherein the periplasmic secretion system is a Sec system. According to one aspect, the polypeptide secretion system includes a periplasmic secretion system and a system for secretion through the outer membrane of the bacterium and wherein the periplasmic secretion system is a twin-arginine translocation (Tat) system. According to one aspect, the polypeptide secretion system includes a periplasmic secretion system and a system for secretion through the outer membrane of the bacterium and wherein the periplasmic secretion system is a signal recognition particle (SRP) system. According to one aspect, the polypeptide secretion system includes a periplasmic secretion system and a system for secretion through the outer membrane of the bacterium and a domain for periplasmic localization is a Sec domain or a Tat domain or a signal recognition particle domain. According to one aspect, the polypeptide secretion system includes a periplasmic secretion system and a system for secretion through the outer membrane of the bacterium and a domain for periplasmic localization is a component of a Sec system, a component of a Tat system or a component of a signal recognition particle system. According to one aspect, the polypeptide secretion system includes a periplasmic secretion system and a system for secretion through the outer membrane of the bacterium and wherein the system for secretion through the outer membrane of the bacterium is a N22 system. According to one aspect, the polypeptide secretion system includes a periplasmic secretion system and a system for secretion through the outer membrane of the bacterium and wherein the system for secretion through the outer membrane of the bacterium is a YebF system. According to one aspect, the polypeptide secretion system includes a periplasmic secretion system and a system for secretion through the outer membrane of the bacterium and wherein a domain for directing the recombinant protein to the outer membrane for secretion is an N22 domain or a YebF domain. According to one aspect, the exogenous nucleic acid further encodes the recombinant protein to include one or more of an amyloid domain, an elastin domain or a collagen domain. According to one aspect, the exogenous nucleic acid further encodes the recombinant protein to include a CsgA domain. According to one aspect, the bacterium is *E. coli*. According to one aspect, the bacterium is non-pathogenic. According to one aspect, the silk fibrin domain includes the amino acid sequence GRGGLGGQGAGMAAAAAMGGAGQGGYGGLGSQGTS (SEQ ID NO:3). According to one aspect, the silk fibrin domain includes 4 to 64 repeats of the amino acid sequence GRGGLGGQGAGMAAAAAMGGAGQGGYGGLGSQGTS (SEQ ID NO:3). According to one aspect, the exogenous nucleic acid further encodes the recombinant protein to include one or more functional proteins. According to one aspect, the exogenous nucleic acid further encodes the recombinant protein to include one or more functional proteins comprising an enzyme, an antibody or a detectable protein. According to one aspect, the recombinant protein is unattached to the bacterium. According to one aspect, the recombinant protein is attached to the bacterium.

Aspects of the present disclosure are directed to a genetically modified bacterium including one or more genomic nucleic acids encoding a polypeptide secretion system and further including an exogenous nucleic acid encoding a recombinant protein including a domain for periplasmic localization, a domain for directing the recombinant protein to the outer membrane for secretion and one or more silk fibroin domains, wherein the exogenous nucleic acid is under operation of a promoter to express the recombinant protein. According to one aspect, the polypeptide secretion system is a Type VIII secretion system or a HlyA Type 1 secretion system. According to one aspect, the polypeptide secretion system includes a periplasmic secretion system and a system for secretion through the outer membrane of the bacterium. According to one aspect, the polypeptide secretion system includes a periplasmic secretion system and a system for secretion through the outer membrane of the bacterium and wherein the periplasmic secretion system is a Sec system. According to one aspect, the polypeptide secretion system includes a periplasmic secretion system and a system for secretion through the outer membrane of the bacterium and wherein the periplasmic secretion system is a twin-arginine translocation (Tat) system. According to one aspect, the polypeptide secretion system includes a periplasmic secretion system and a system for secretion through the outer membrane of the bacterium and wherein the periplasmic secretion system is a signal recognition particle (SRP) system. According to one aspect, the polypeptide secretion system includes a periplasmic secretion system and a system for secretion through the outer membrane of the bacterium and a domain for periplasmic localization is a Sec domain or a Tat domain or a signal recognition particle domain. According to one aspect, the polypeptide secretion system includes a periplasmic secretion system and a system for secretion through the outer membrane of the bacterium and a domain for periplasmic localization is a component of a Sec system, a component of a Tat system or a component of a signal recognition particle system. According to one aspect, the polypeptide secretion system includes a periplasmic secretion system and a system for secretion through the outer membrane of the bacterium and wherein the system for secretion through the outer membrane of the bacterium is a N22 system. According to one aspect, the polypeptide secretion system includes a periplasmic secretion system and a system for secretion through the outer membrane of the bacterium and wherein the system for secretion through the outer membrane of the bacterium is a YebF system. According to one aspect, the polypeptide secretion system includes a periplasmic secretion system and a system for secretion through the outer membrane of the bacterium and wherein a domain for directing the recombinant protein to the outer membrane for secretion is an N22 domain or a YebF domain. According to one aspect, the exogenous nucleic acid further encodes the recombinant protein to include one or more of an amyloid domain, an elastin domain or a collagen domain. According to one aspect, the exogenous nucleic acid further encodes the recombinant protein to include a CsgA domain. According to one aspect, the bacterium is E. coli. According to one aspect, the bacterium is non-pathogenic. According to one aspect, the silk fibrin domain includes the amino acid sequence GRGGLGGQGAGMAAAAAMGGAGQGGYG-GLGSQGTS (SEQ ID NO:3). According to one aspect, the silk fibrin domain includes 4 to 64 repeats of the amino acid sequence GRGGLGGQGAGMAAAAAMGGAGQGGYG-GLGSQGTS (SEQ ID NO:3). According to one aspect, the exogenous nucleic acid further encodes the recombinant protein to include one or more functional proteins. According to one aspect, the exogenous nucleic acid further encodes the recombinant protein to include one or more functional proteins comprising an enzyme, an antibody or a detectable protein. According to one aspect, the recombinant protein is unattached to the bacterium. According to one aspect, the recombinant protein is attached to the bacterium.

In some embodiments, the heterologous nucleic acid encoding a recombinant silk protein further comprises a heterologous nucleic acid encoding a functional protein. In some embodiments, the heterologous nucleic acid encoding a recombinant silk protein further comprises one or more (e.g., two, three, four, five, six, or more) heterologous nucleic acid encoding a functional protein. In some embodiments, the recombinant silk protein further comprises a functional protein domain (e.g., the recombinant silk protein is fused to a functional protein described herein). In some embodiments, the recombinant silk protein comprises one or more (e.g., two, three, four, five, six, or more) functional proteins. In some embodiments, the functional protein comprises an enzyme, an antibody, a detectable protein, or a fragment thereof. In some embodiments, the detectable protein is a poly-histidine tag, a myc tag a FLAG tag, a hemagglutinin (HA) tag, or a V5 tag.

In some embodiments, the heterologous nucleic acid encoding a recombinant silk protein further comprises a heterologous nucleic acid encoding a protease cleavage site amino acid sequence. In some embodiments, the recombinant silk protein further comprises a protease cleavage site amino acid sequence. The protease cleavage site amino acid sequence may be disposed at any location between the multiple domains of the recombinant silk protein, including for example: between a periplasmic translocation signal sequence and an outer membrane secretion signal sequence, between an outer membrane secretion signal sequence and a silk fibroin domain, between a periplasmic translocation signal sequence and a silk fibroin domain, between an outer membrane secretion signal sequence and an amyloid domain, between a periplasmic translocation signal sequence and an amyloid domain, between a first silk fibroin domain and a second silk fibroin domain, between a silk fibroin domain and an amyloid domain, between an amyloid domain and a functional protein, between a silk fibroin domain and a functional protein.

In some embodiments, the heterologous nucleic acid encoding a recombinant silk protein further comprises a heterologous nucleic acid encoding a linker sequence. In some embodiments, the recombinant silk protein further comprises a linker sequence. The linker sequence may be disposed at any location between the multiple domains of the recombinant silk protein, including for example: between a periplasmic translocation signal sequence and an outer membrane secretion signal sequence, between an outer membrane secretion signal sequence and a silk fibroin domain, between a periplasmic translocation signal sequence and a silk fibroin domain, between a first silk fibroin domain and a second silk fibroin domain, between a silk fibroin domain and an amyloid domain, between an amyloid domain and a functional protein, between a silk fibroin domain and a functional protein.

Aspects of the present disclosure are directed to a non-naturally occurring protein including a fusion of a domain for periplasmic localization of the protein to periplasm of a bacterium, a domain for directing the protein to the outer membrane of a bacterium for secretion and one or more silk fibroin domains.

Aspects of the present disclosure are directed to a nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

Aspects of the present disclosure are directed to a vector comprising a nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

In one aspect, described herein are vectors comprising a heterologous nucleic acid described herein (e.g., a heterologous nucleic acid encoding a recombinant silk protein, wherein the recombinant silk protein comprises a periplasmic translocation signal sequence, an outer membrane secretion signal sequence, a silk fibroin domain, and optionally, one or more of an amyloid domain, an elastin domain, and a collagen domain).

Aspects of the present disclosure are directed to a bacterium including a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

Aspects of the present disclosure are directed to a bacterium including a vector comprising a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

Aspects of the present disclosure are directed to a bacterium expressing a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

Aspects of the present disclosure are directed to a biofilm including a bacterium expressing a foreign or exogenous nucleic acid sequence encoding a non-naturally occurring protein including a fusion of a domain for periplasmic localization of the protein to periplasm of a bacterium, a domain for directing the protein to the outer membrane of a bacterium for secretion and one or more silk fibroin domains.

A "vector" includes a nucleic acid construct designed for delivery to a host cell or transfer between different host cells (e.g., a bacterial cell described herein). A vector can be viral or non-viral. Many vectors useful for transferring genes into target cells are available, e.g., the vectors may be episomal, e.g., plasmids, virus-derived vectors, or may be integrated into the target cell genome, through homologous recombination or random integration.

In some embodiments, a vector can be an expression vector. An "expression vector" can be a vector that has the ability to incorporate and express heterologous nucleic acid fragments in a cell. An expression vector may comprise additional elements, for example, the expression vector may have two replication systems, thus allowing it to be maintained in two organisms. The nucleic acid incorporated into the vector can be operably-linked to an expression control sequence when the expression control sequence controls and regulates the transcription and translation of that polynucleotide sequence.

In some embodiments, a heterologous nucleic acid encoding a recombinant silk protein, wherein the recombinant silk protein comprises a periplasmic translocation signal sequence, an outer membrane secretion signal sequence, and a silk fibroin domain; or a nucleic acid encoding a recombinant protein including one or more silk fibroin domains and one or more of a domain for periplasmic localization, a domain for directing the recombinant protein to the outer membrane for secretion, or a functional polypeptide such as an amyloid domain, an elastin domain or a collagen domain; can be present within a portion of a plasmid. Plasmid vectors include, but are not limited to, pBR322, pBR325, pACYC177, pACYC184, pUC8, pUC9, pUC18, pUC19, pLG339, pR290, pKC37, pKC101, SV 40, pBluescript II SK +/− or KS +/− (see "Stratagene Cloning Systems" Catalog (1993) from Stratagene, La Jolla, Calif., which is hereby incorporated by reference), pQE, pIH821, pGEX, pET series (see Studier et al., "Use of T7 RNA Polymerase to Direct Expression of Cloned Genes," Gene Expression Technology, vol. 185 (1990), which is hereby incorporated by reference in its entirety).

A "viral vector" may be a nucleic acid vector construct that includes at least one element of viral origin and has the capacity to be packaged into a viral vector particle. The viral vector can contain a transgenic gene in place of non-essential viral genes. The vector and/or particle may be utilized for the purpose of transferring any nucleic acids into cells either in vitro or in vivo. Numerous viral vectors are known in the art and can be used as carriers of a nucleic acid into a cell, e.g. lambda vector system gt11, gt WES.tB, Charon 4.

In some embodiments, a heterologous nucleic acid described herein; such as a nucleic acid encoding a recombinant protein including one or more silk fibroin domains and one or more of a domain for periplasmic localization, a domain for directing the recombinant protein to the outer membrane for secretion, or a functional polypeptide such as an amyloid domain, an elastin domain or a collagen domain; can be constitutively expressed. In some embodiments, a heterologous nucleic acid described herein can be operably-linked to a constitutive promoter. In some embodiments, the heterologous nucleic acid described herein can be inducibly-expressed. In some embodiments, the heterologous nucleic acid described herein can be operably linked to an inducible promoter. In some embodiments, the heterologous nucleic acid described herein can be operably-linked to a native CsgA promoter.

An "inducible promoter" may be one that is characterized by initiating or enhancing transcriptional activity when in the presence of, influenced by, or contacted by an inducer or inducing agent than when not in the presence of, under the influence of, or in contact with the inducer or inducing agent. An "inducer" or "inducing agent" may be endogenous, or a normally exogenous compound or protein that is administered in such a way as to be active in inducing transcriptional activity from the inducible promoter. In some embodiments, the inducer or inducing agent, e.g., a chemical, a compound or a protein, can itself be the result of transcription or expression of a nucleic acid sequence (e.g., an inducer can be a transcriptional repressor protein), which itself may be under the control or an inducible promoter. Non-limiting examples of inducible promoters include but are not limited to, the lac operon promoter, a nitrogen-sensitive promoter, an IPTG-inducible promoter, a salt-inducible promoter, and tetracycline, steroid-responsive promoters, rapamycin responsive promoters and the like. Inducible promoters for use in prokaryotic systems are well known in the art, see, e.g., the beta-lactamase and lactose promoter systems (Chang et al., *Nature,* 275: 615 (1978), which is incorporated herein by reference); Goeddel et al., *Nature,* 281: 544 (1979), which is incorporated herein by reference), the arabinose promoter system, including the araBAD promoter (Guzman et al., *J. Bacteriol.,* 174: 7716-7728 (1 992), which is incorporated herein by reference; Guzman et al., *J. Bacteriol.,* 177: 4121-4130 (1995), which is incorporated herein by reference; Siegele and Hu, *Proc. Natl. Acad. Sci. USA,* 94: 8168-8172 (1997), which is incorporated herein by reference), the rhamnose promoter (Haldimann et al., *J. Bacteriol.,* 180: 1277-1286 (1998), which is incorporated herein by reference), the alkaline phosphatase promoter, a tryptophan (trp) promoter system (Goeddel, *Nucleic Acids Res.,* 8: 4057 (1980), which is incorporated herein by reference), the PLtetO-1 and Plac/are-1 promoters (Lutz and Bujard, *Nucleic Acids Res.,* 25: 1203-1210 (1997), which is incorporated herein by reference), and hybrid promoters such as the tac promoter (deBoer et al., *Proc. Natl. Acad. Sci. USA,* 80: 21-25 (1983), which is incorporated herein by reference).

In some embodiments, the heterologous nucleic acid described herein is operably linked to a promoter. In some embodiments, the promoter is a constitutive promoter. In some embodiments, the promoter is an inducible promoter. An inducible promoter useful in the methods and systems as disclosed herein can be induced by one or more physiological conditions, such as changes in pH, temperature, radiation, osmotic pressure, saline gradients, cell surface binding, and the concentration of one or more extrinsic or intrinsic inducing agents. The extrinsic inducer or inducing agent may comprise amino acids and amino acid analogs, saccharides and polysaccharides, nucleic acids, protein transcriptional activators and repressors, cytokines, toxins, petroleum-based compounds, metal containing compounds, salts, ions, enzyme substrate analogs, hormones, and combinations thereof. In specific embodiments, the inducible promoter is activated or repressed in response to a change of an environmental condition, such as the change in concentration of a chemical, metal, temperature, radiation, nutrient or change in pH. Thus, an inducible promoter useful in the methods and systems as disclosed herein can be a phage inducible promoter, nutrient inducible promoter, temperature inducible promoter, radiation inducible promoter, metal inducible promoter, hormone inducible promoter, steroid inducible promoter, and/or hybrids and combinations thereof. Appropriate environmental inducers can include, but are not limited to, exposure to heat (i.e., thermal pulses or constant heat exposure), various steroidal compounds, divalent cations (including $Cu^{2+}$ and $Zn^{2+}$), galactose, tetracycline, IPTG (isopropyl-β-D thiogalactoside), as well as other naturally occurring and synthetic inducing agents and gratuitous inducers.

Inducible promoters useful in the methods and systems as disclosed herein also include those that are repressed by "transcriptional repressors" that are subject to inactivation by the action of environmental, external agents, or the product of another gene. Such inducible promoters may also be termed "repressible promoters" where it is required to distinguish between other types of promoters in a given module or component of the biological switch converters described herein. Preferred repressors for use in the present invention are sensitive to inactivation by physiologically benign agent. Thus, where a lac repressor protein is used to control the expression of a promoter sequence that has been engineered to contain a lacO operator sequence, treatment of the host cell with IPTG will cause the dissociation of the lac repressor from the engineered promoter containing a lacO operator sequence and allow transcription to occur. Similarly, where a tet repressor is used to control the expression of a promoter sequence that has been engineered to contain a tetO operator sequence, treatment of the host cell with tetracycline will cause the dissociation of the tet repressor from the engineered promoter and allow transcription of the sequence downstream of the engineered promoter to occur.

A bacterial cell for use in the methods and compositions described herein can be any of any species. Preferably, the bacterial cells are of a species and/or strain which is amenable to culture and genetic manipulation. In some embodiments, the bacterial cell is a Gram-positive bacterial cell. In some embodiments, the bacterial cell is a Gram-negative bacterial cell. In some embodiments, the parental strain of the bacterial cell of the technology described herein can be a strain optimized for protein expression. Non-limiting examples of bacterial species and strains suitable for use in the present technologies include *Escherichia coli, E. coli* BL21, *E. coli* Tuner, *E. coli* Rosetta, *E. coli* JM101, and derivatives of any of the foregoing. Bacterial strains for protein expression are commercially available, e.g. EXPRESS™ Competent *E. coli* (Cat. No. C2523; New England Biosciences; Ipswich, Mass.). In some embodiments, the cell is an *E. coli* cell.

In some embodiments, the bacterium expresses wild-type CsgA. In some embodiments, the bacterium comprises a mutation and/or deletion in the wild-type CsgA gene, e.g., such that the cell does not express wild-type CsgA. In some embodiments, the heterologous nucleic acid described herein is introduced into a bacterial cell by homologous recombination, e.g., such that the heterologous nucleic acid replaces an endogenous csgA gene in the bacterial genome.

In one aspect, provided herein is a method for producing a recombinant silk protein comprising culturing an engineered bacterium described herein under conditions suitable for the expression of the recombinant silk protein in the engineered bacterium. In some embodiments, the recombinant silk protein is secreted from the engineered bacterium. In some embodiments, the methods comprise collecting the recombinant silk protein from the cell culture medium comprising the engineered bacterium or in which the engineered bacterium was cultured.

In some embodiments, the engineered bacterium is not exposed to a lysing agent prior to collecting the recombinant protein from the cell culture medium. In some embodiments, the recombinant polypeptide is collected from a supernatant of the cell culture medium. Methods for collecting a recombinant polypeptide from a cell culture medium are well known in the art, and include, for example, filtration, centrifugation, dialysis, ultrafiltration, and lyophilization.

In some embodiments, the methods of producing a recombinant polypeptide described herein further comprise purifying the recombinant polypeptide. Recombinant polypeptides can also be isolated from cellular lysates and/or cell culture medium by using any standard technique known in the art. For example, recombinant polypeptides can be engineered to comprise an epitope tag such as a poly-histidine tag or other polypeptide tag such as myc or FLAG. Purification can be achieved by immunoprecipitation using antibodies specific to the recombinant peptide (or any epitope tag comprised in the amino sequence of the recombinant polypeptide) or by running the lysate solution or cell culture medium through an affinity column that comprises a matrix for the polypeptide or for any epitope tag comprised in the recombinant polypeptide (see for example, Ausubel et al., eds. (1993) Current Protocols in Molecular Biology, Section 10.11.8, John Wiley & Sons, New York).

Other methods for purifying a recombinant polypeptide include, but are not limited to ion exchange chromatography, hydroxylapatite chromatography, hydrophobic interaction chromatography, preparative isoelectric focusing chromatography, molecular sieve chromatography, HPLC, native gel electrophoresis in combination with gel elution, affinity chromatography, and preparative isoelectric. See, e.g., Marston et al. (1990) *Meth. Enz.,* 182:264-275.

In another aspect, the present disclosure provides a recombinant silk protein as described herein. In some embodiments, the recombinant silk protein is produced using the methods described herein. In some embodiments, the recombinant silk protein comprises a periplasmic translocation signal sequence, an outer membrane signal sequence and a silk fibroin domain. In some embodiments, the recombinant silk protein comprises an outer membrane signal sequence and a silk fibroin domain. In some embodiments, the recombinant silk protein comprises an periplasmic translocation signal sequence and a silk fibroin domain. In some embodiments, the recombinant silk protein comprises a silk fibroin domain. In some embodiments, the recombinant silk protein comprises a periplasmic translocation signal sequence, an outer membrane signal sequence, a silk fibroin domain, and one or more of an amyloid domain (e.g., CsgA), an elastin domain, and a collagen domain. In some embodiments, the recombinant silk protein comprises an outer membrane signal sequence, a silk fibroin domain, and one or more of an amyloid domain (e.g., CsgA), an elastin domain, and a collagen domain. In some embodiments, the recombinant silk protein comprises a periplasmic translocation signal sequence, a silk fibroin domain, and one or more of an amyloid domain (e.g., CsgA), an elastin domain, and a collagen domain. In some embodiments, the recombinant silk protein comprises a silk fibroin domain, and one or more of an amyloid domain (e.g., CsgA), an elastin domain, and a collagen domain. In some embodiments, the recombinant silk protein further comprises a functional protein selected from the group consisting of an enzyme, an antibody and a detectable protein. In some embodiments, the detectable protein is selected from the group consisting of poly-histidine tag, a myc tag, a FLAG tag, a hemagglutinin (HA) tag, and a V5 tag. In some embodiments, the recombinant polypeptide comprises a protease cleavage site amino acid sequence.

In another aspect, provided herein is a curli fiber comprising a plurality of recombinant silk proteins as described herein. In some embodiments, the curli fiber comprises a plurality of recombinant silk proteins, wherein the plurality of silk proteins comprise a silk fibroin domain and an amyloid domain. In some embodiments, the curli fiber comprises a plurality of recombinant silk proteins, wherein the plurality of silk proteins comprise a periplasmic translocation signal sequence, an outer membrane signal sequence, a silk fibroin domain, an amyloid domain (e.g., CsgA), and optionally, one or more of an elastin domain, and a collagen domain. In some embodiments, the curli fiber comprises a plurality of recombinant silk proteins, wherein the plurality of silk proteins comprise an outer membrane signal sequence, a silk fibroin domain, an amyloid domain (e.g., CsgA), and optionally, one or more of an elastin domain, and a collagen domain. In some embodiments, the curli fiber comprises a plurality of recombinant silk proteins, wherein the plurality of silk proteins comprise a periplasmic translocation signal sequence, a silk fibroin domain, an amyloid domain (e.g., CsgA), and optionally, one or more of an elastin domain, and a collagen domain. In some embodiments, the curli fiber comprises a plurality of recombinant silk proteins, wherein the plurality of silk proteins comprise a silk fibroin domain, an amyloid domain (e.g., CsgA), and optionally, one or more of an elastin domain, and a collagen domain. In some embodiments, the curli fiber comprises a plurality of recombinant silk proteins, wherein the plurality of silk proteins further comprises a functional protein selected from the group consisting of an enzyme, an antibody and a detectable protein. In some embodiments, the detectable protein is selected from the group consisting of poly-histidine tag, a myc tag, a FLAG tag, a hemagglutinin (HA) tag, and a V5 tag. In some embodiments, the curli fiber comprises a plurality of recombinant silk proteins, wherein the plurality of silk proteins comprise a protease cleavage site amino acid sequence.

In one aspect, provided herein is a biofilm comprising an engineered bacterium described herein, e.g., an engineered bacterium comprising a heterologous nucleic acid encoding a recombinant silk protein, wherein the recombinant silk protein comprises a periplasmic translocation signal sequence, an outer membrane secretion signal sequence, and a silk fibroin domain. In another aspect, provided herein is a biofilm comprising a cell comprising one or more engineered CsgA polypeptide and/or comprising a vector or nucleic acid encoding such a polypeptide.

In another aspect, provided herein is a biofilm comprising a curli fiber formed from a plurality of recombinant silk proteins as described herein. In some embodiments, the biofilm comprises a curli fiber formed from a plurality of recombinant silk proteins, wherein the recombinant silk proteins comprise a silk fibroin domain and an amyloid domain.

As used herein, a "biofilm" refers to a mass of microorganisms which can adhere or is adhering to a surface. A biofilm comprises a matrix of extracellular polymeric substances, including, but not limited to extracellular DNA, proteins, glycopeptides, and polysaccharides. The nature of a biofilm, such as its structure and composition, can depend on the particular species of bacteria present in the biofilm. Bacteria present in a biofilm are commonly genetically or phenotypically different than corresponding bacteria not in a biofilm, such as isolated bacteria or bacteria in a colony.

In some embodiments, the technology described herein relates to a biofilm that is produced by culturing an engineered bacterium described herein under conditions suitable for the production of a biofilm. Conditions suitable for the production of a biofilm can include, but are not limited to, conditions under which the microbial cell is capable of logarithmic growth and/or polypeptide synthesis. Conditions may vary depending upon the species and strain of microbial cell selected. Conditions for the culture of microbial cells are well known in the art. Biofilm production can also be induced and/or enhanced by methods well known in the art, e.g. contacting cells with subinhibitory concentrations of beta-lactam or aminoglycoside antibiotics, exposing cells to fluid flow, contacting cells with exogenous poly-N-acetylglucosamine (PNAG), or contacting cells with quorum sensing signal molecules. In some embodiments, conditions suitable for the production of a biofilm can also include conditions which increase the expression and secretion of CsgA, e.g., by exogenously expressing CsgD. In some embodiments, the biofilm can comprise the bacterium which produced the biofilm. In some embodiments, described herein is a composition comprising an engineered CsgA polypeptide which includes CsgA attached to a polypeptide such as spider silk, as described herein.

When expressed by a bacterium capable of forming curli, e.g. a bacterium expressing CsgA, CsgB, CsgC, CsgD, CsgE, CsgF, and CsgG or some subset thereof, CsgA units will be assembled to form curli filaments, e.g., polymeric chains of CsgA or of a recombinant silk protein comprising an amyloid domain as described herein. In some embodiments, filaments of the polypeptide can be present in the composition. In some embodiments, the filaments can be part of a proteinaceous network, e.g., multiple filaments which can be, e.g., interwoven, overlapping, and/or in contact with each other. In some embodiments, the proteinaceous network can comprise additional biofilm components, e.g., materials typically found in an $E.\ coli$ biofilm. Non-limiting examples of biofilm components can include biofilm proteins (e.g. FimA, FimH, Ag43, AidA, and/or TibA) and/or non-proteinaceous biofilm components (e.g. cellulose, PGA and/or colonic acid). In some embodiments, the composition can further comprise a cell comprising an engineered CsgA polypeptide and/or comprising a vector or nucleic acid encoding such a polypeptide.

Definitions of common terms in cell biology and molecular biology can be found in The Encyclopedia of Molecular Biology, published by Blackwell Science Ltd., 1994 (ISBN 0-632-02182-9); Benjamin Lewin, Genes X, published by Jones & Bartlett Publishing, 2009 (ISBN-10: 0763766321); Kendrew et al. (eds.), Molecular Biology and Biotechnology: a Comprehensive Desk Reference, published by VCH Publishers, Inc., 1995 (ISBN 1-56081-569-8) and Current Protocols in Protein Sciences 2009, Wiley Intersciences, Coligan et al., eds.

Unless otherwise stated, the present invention was performed using standard procedures, as described, for example in Sambrook et al., Molecular Cloning: A Laboratory Manual (3 ed.), Cold Spring Harbor Laboratory Press, Cold Spring Harbor, N.Y., USA (2001); Davis et al., Basic Methods in Molecular Biology, Elsevier Science Publishing, Inc., New York, USA (1995); or Methods in Enzymology: Guide to Molecular Cloning Techniques Vol.152, S. L. Berger and A. R. Kimmel Eds., Academic Press Inc., San Diego, USA (1987); and Current Protocols in Protein Science (CPPS) (John E. Coligan, et. al., ed., John Wiley and Sons, Inc.), which are all incorporated by reference herein in their entireties.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

The following examples are set forth as being representative of the present disclosure. These examples are not to be construed as limiting the scope of the present disclosure as these and other equivalent embodiments will be apparent in view of the present disclosure, figures and accompanying claims.

EXAMPLE I

Genetic Construction of Silk Gene Constructs

Protein motifs of dragline silk from *Nephila clavipes* (Golden Silk Orb-weaving spider) were synthetically synthesized and concatenated using molecular biology techniques to create silk domains and amyloid-silk domain fusions that are secreted through the T8SS functional amyloid secretion pathway of *E. coli*. Additional consensus dragline silk sequences are set forth in SEQ ID NOs:2054-2074.

Figure 2:
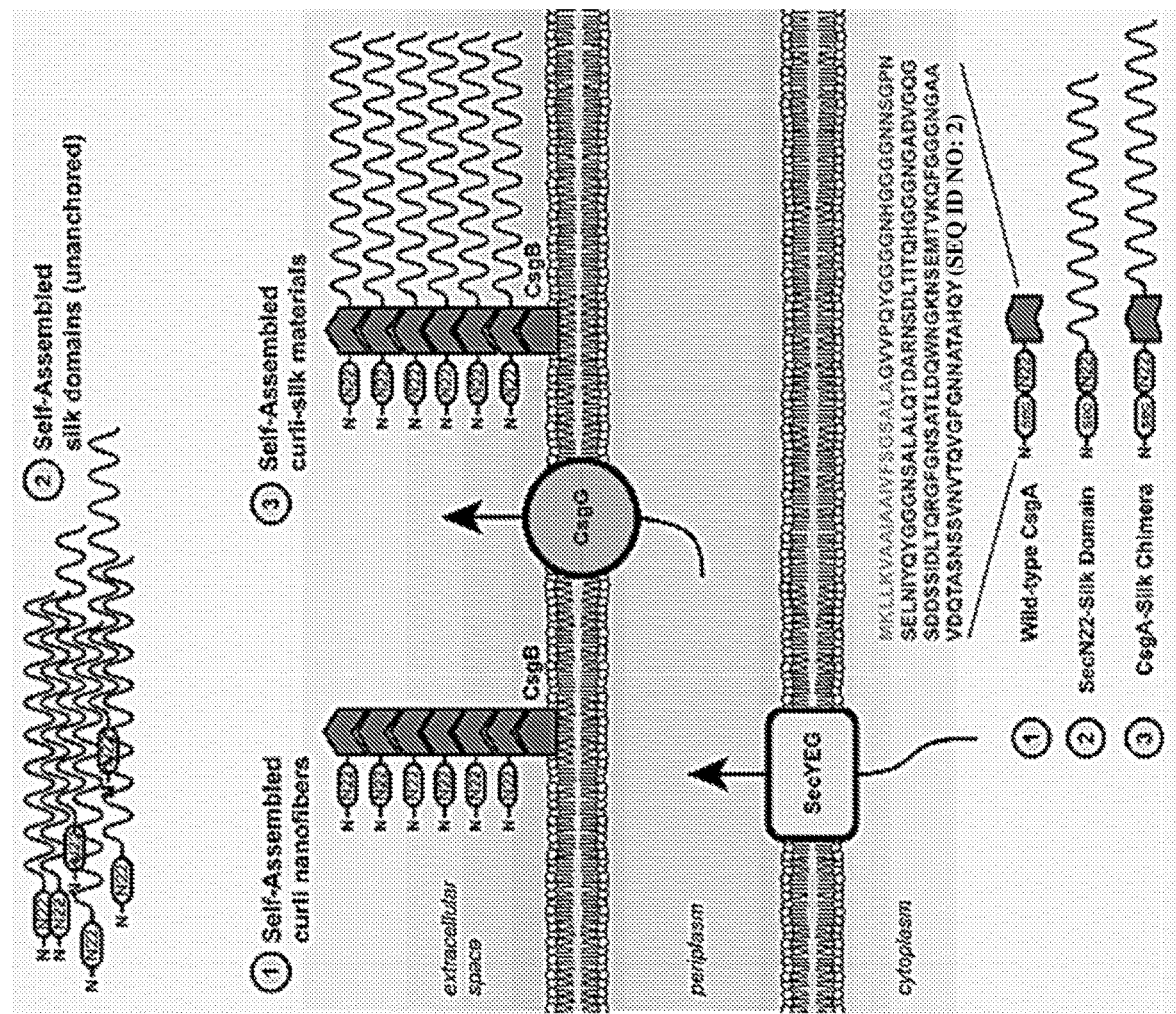
FIG. 2 depicts in schematic secretion of silk product using the T8SS bacterial functional amyloid secretion system.
Figure 3B:
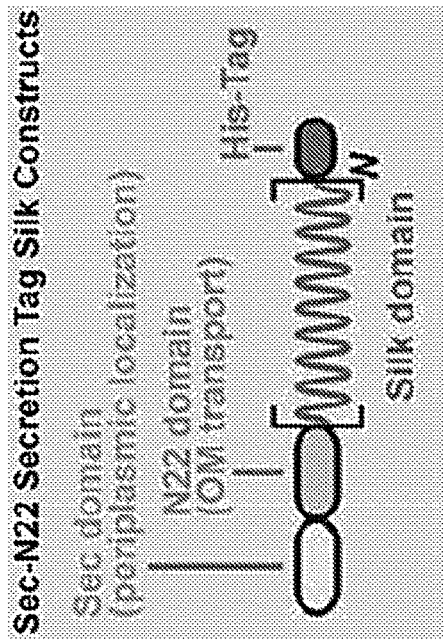
Figure 3B:
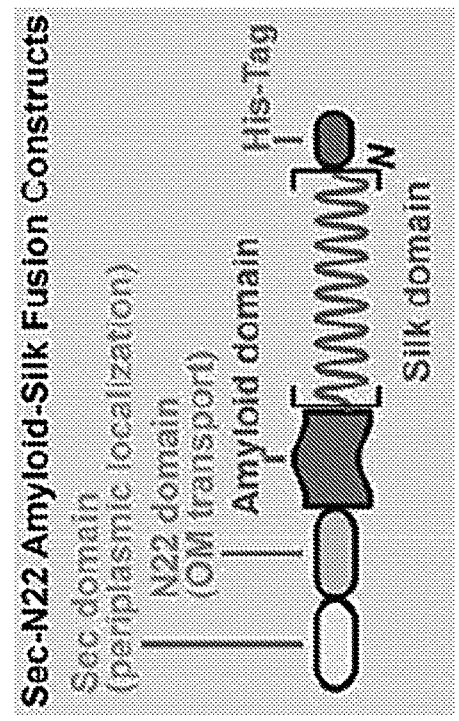

Spider silk from the Golden Silk Orb-weaving spider *Nephila clavipes* has been extensively studied for its mechanical properties. The major protein constituent of dragline silk from *N. clavipes* is the major ampullate spidroin-1 (MaSp1). The repetitive domain of the silks is a repeated protein motif that influences its resulting mechanical properties. As depicted in FIGS. 3A and 3B, the repetitive 35-amino acid peptide motif was used as the 'silk domain' in the constructs, which were synthetized and engineered into fusion proteins containing 4, 8, 16, 32, and 64 head-to-tail repeating domains, ranging in size from 17-202 amino acids. To test the ability of these constructs to be secreted from the cells via the T8SS pathway, a N-terminal tag was added consisting of the CsgA signal sequence, consisting of a 20-amino acid Sec sequence for periplasmic localization and a 22-amino acid N22 domain which directs the protein to the CsgG/CsgE outer membrane complex for secretion. A second set of fusion constructs with the full CsgA protein located N-terminal to the silk domain, resulting in bifunctional self-assembling silks, was also tested for secretion. See FIG. 2.

Figure 6A:
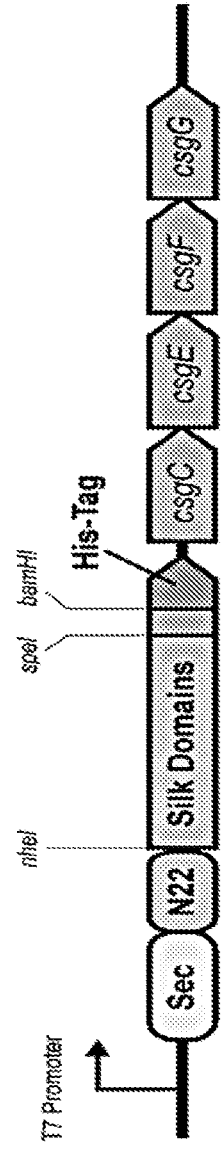
FIG. 6A-6C are schematics showing constructs described herein.
Figure 6B:
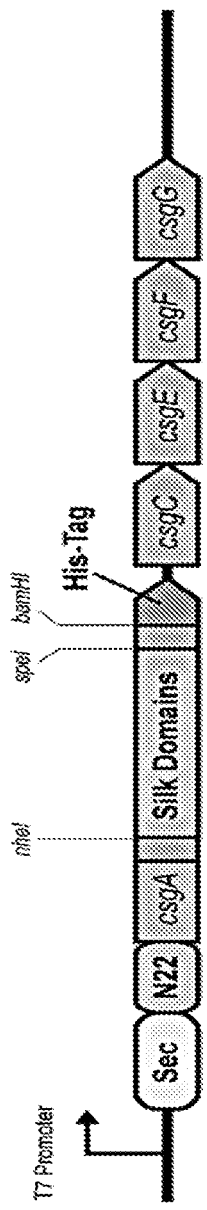
Figure 6C:
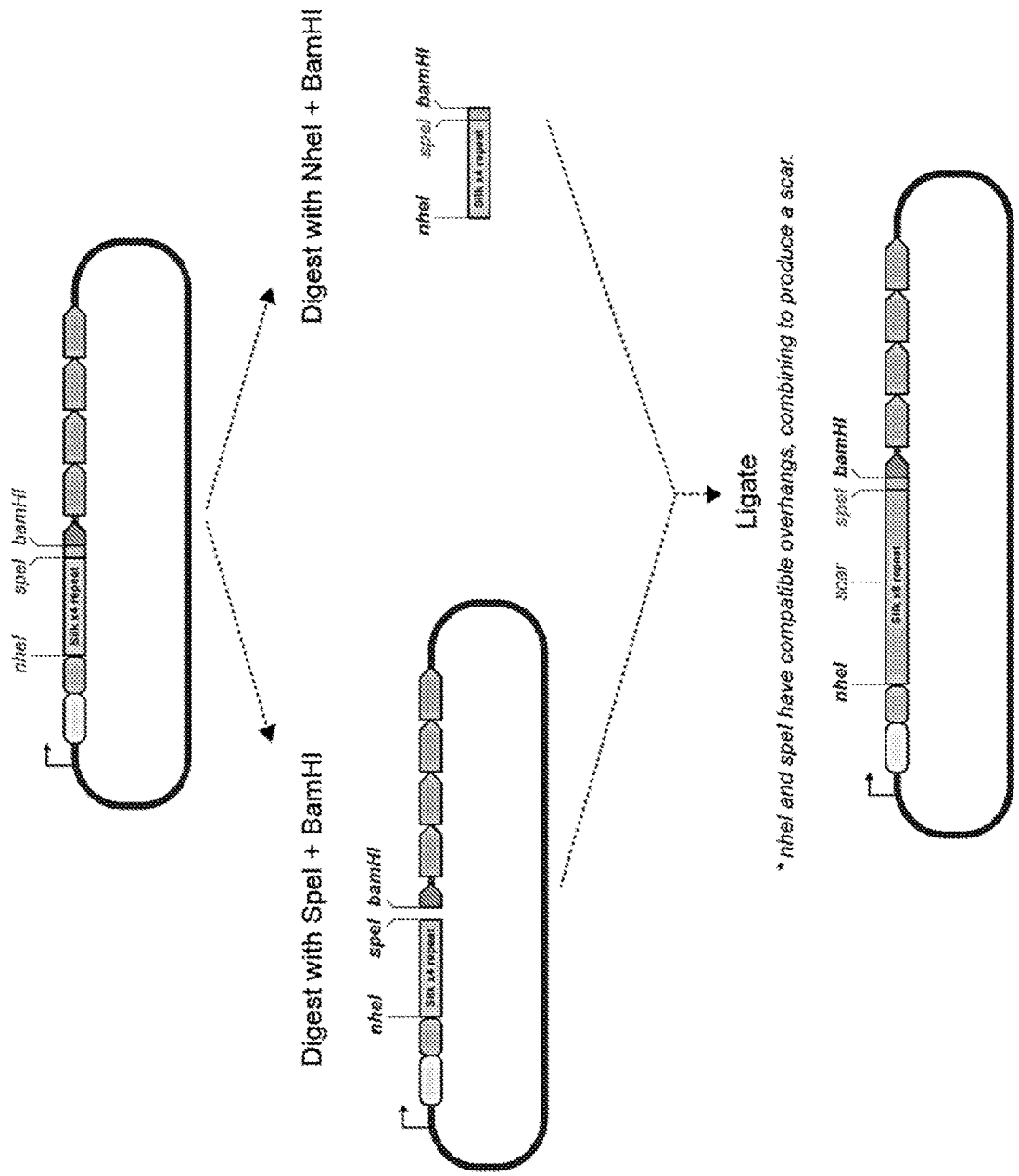
Figure 7:
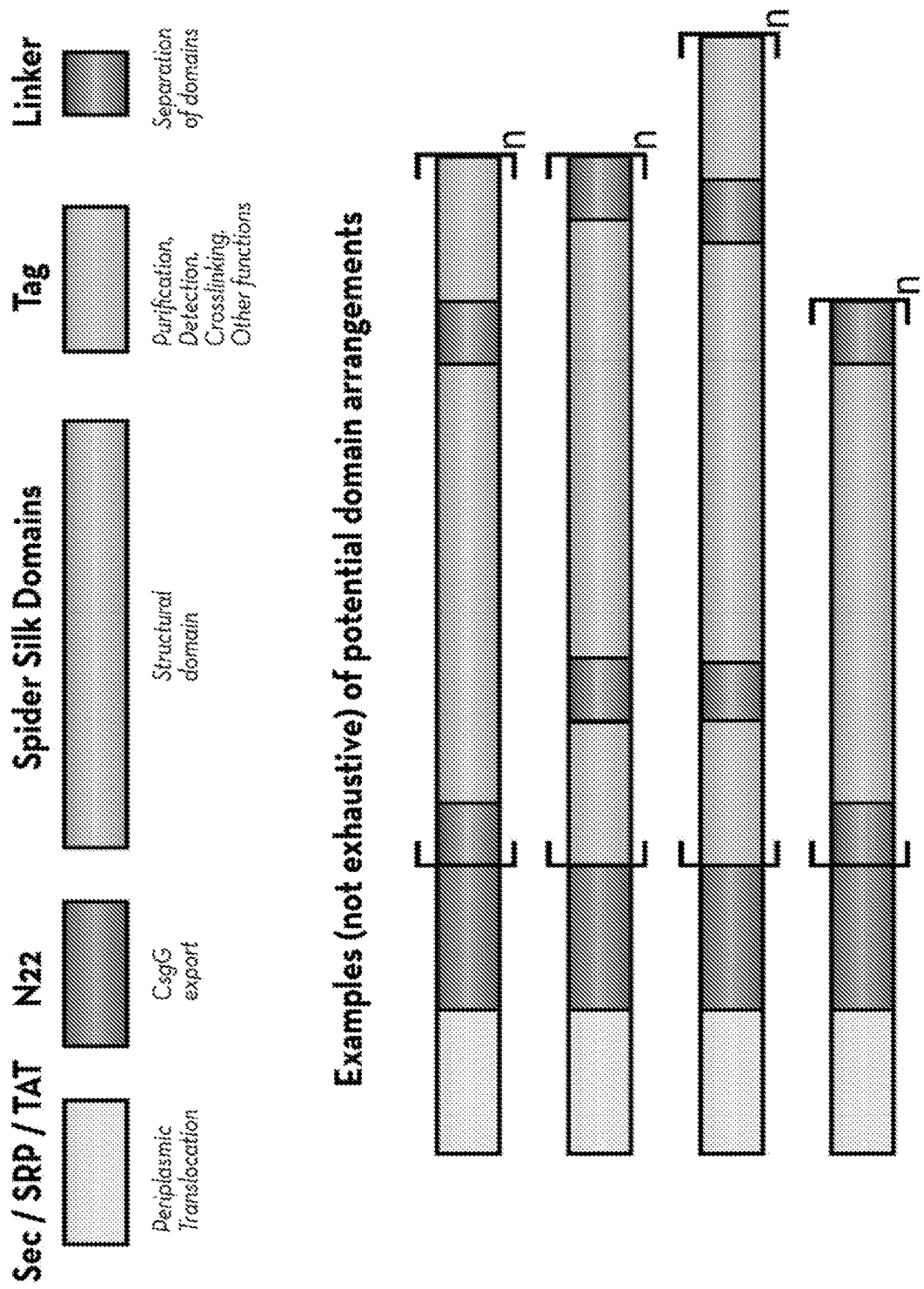
FIG. 7 schematically represents domain arrangements of potential domain arrangements of recombinant silk proteins described herein.

More specifically, and with reference to FIG. 6, the gene for the major ampullate spidroin 1 spider silk protein from *Nephila clavipes* was computationally codon optimized for *Escherichia coli* expression from the know protein sequence (see Xu, M., & Lewis, R. V. (1990) Structure of a protein superfiber: spider dragline silk. *Proc. Natl. Acad. Sci.* USA, 87(18), 7120-7124, hereby incorporated by reference in its entirety.

Using this optimized gene sequence, a 4-mer containing four consecutive repeats of the spider silk domain was ordered as a synthetic DNA construct with flanking restriction sites which allowed head-to-tail concatenation through molecular biology cloning to generate longer proteins with repeating spider silk domains. This is advantageous as the molecular weight of the spider silk proteins directly correlates with the physical properties of the spider silk. See Xia, X.-X., Qian, Z.-G., Ki, C. S., Park, Y. H., Kaplan, D. L., & Lee, S. Y. (2010). Native-sized recombinant spider silk protein produced in metabolically engineered *Escherichia coli* results in a strong fiber. *Proc. Natl. Acad. Sci.* USA 107(32), 14059-14063, hereby incorporated by reference in its entirety.

The 4-mer repeat, herein referred to as Silk4, was created with an N-terminal NheI restriction site. Immediately following the Silk4 domain, the construct was engineered with a multiple cloning site consisting of SpeI-KpnI-BamHI, a 6×-histidine tag, and finally, a stop codon. The final plasmid was inserted into pET30a-ACEFG plasmid, which contains 5 genes of the wildtype curli operon, csgA, csgC, csgE, csgF, and csgG. For the spider silk only constructs, the Silk4 construct was inserted in place of the CsgA curlin domains, resulting in a Sec-N22 tagged Silk4 construct. For the spider silk-CsgA fusions, the Silk4 construct was cloned behind the csgA gene to create a fusion protein containing the native CsgA protein, a -GSGGSG-linker, and the Silk4 construct.

To generate expression constructs containing various amounts of spider silk domains, the designed restriction sites were used in a concatenation strategy to generate Silk8 (8 consecutive domains), Silk16 (16 consecutive domains), Silk32 (32 consecutive domains), and Silk64 (64 consecutive domains). Briefly, the Silk4 constructs were digested by NheI and BamHI and the Silk4 dropout was isolated. Also, the Silk4 constructs were digested by SpeI and BamHI and the major linearized plasmid was isolated. The dropout was ligated into the digested plasmid. Since NheI and SpeI have compatible overhangs, they combine to generate a "scar" in which two concatenated Silk4 domains are linked by nucleotides encoding for an -AS-linker. This resulting plasmid, containing 8 total spider silk domains, was named Silk8. The remaining signal sequence only and CsgA fusion constructs were cloned in a similar manner.

EXAMPLE II

Expression of Spider Silk Domains Using the CsgA (Sec-N22) Signal Sequence

For the experiments shown herein, the Rosetta-gami 2(DE3) cell lines from Novagen, which are pET vector compatible, were used. The constructs here could also be cloned into other plasmid systems and other *E. coli* strains. To test the transformed cells for spider silk expression, LB plates were made with the proper plasmid selectable marker and supplemented with 30 µg/mL of Congo red dye and 0.05 mM IPTG. Congo red has been shown to bind to silk, and any extracellularly produced silk will bind to the dye. See Slotta, U., Hess, S., SpieB, K., Stromer, T., Serpell, L., & Scheibel, T. (2007). Spider Silk and Amyloid Fibrils: A Structural Comparison. *Macromolecular Bioscience*, 7(2), 183-188, hereby incorporated by reference in its entirety.

All transformants were grown in LB media with antibiotic and 0.5% glucose overnight at room temperature, pelleted, and then resuspended in LB to an OD600 of 0.5. This culture was then spotted onto the LB—Congo red agar plates, allowed to dry, and then incubated at 25° C. for 48 hours before imaging.

Figure 4:
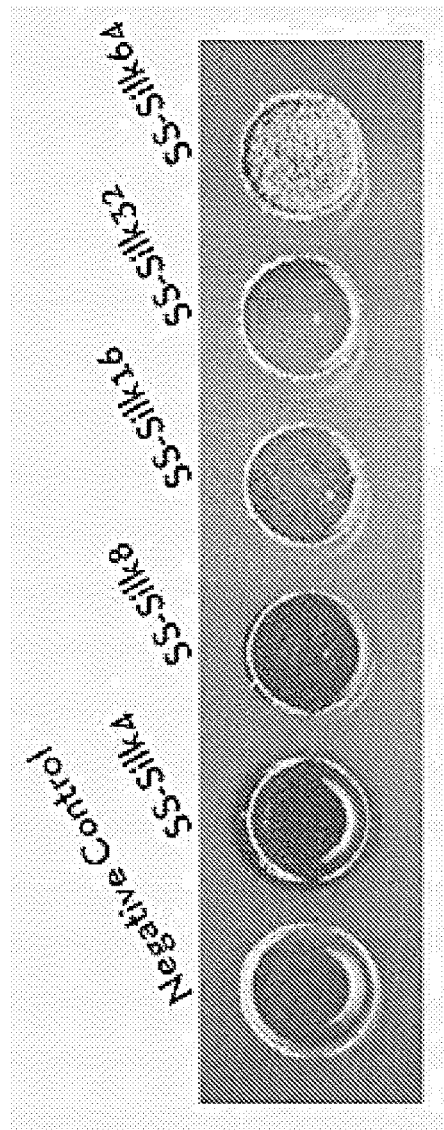
FIG. 4 illustrates that Sec-N22-[Silk]$_N$-HisTag constructs are secreted by the *E. coli* T8SS pathway. SS-Silk constructs transformed into *E. coli* and plated onto Congo Red LB plates and induced with 0.05 mM IPTG. The negative control plasmid encodes for a non-CR binding protein, BSA.

Spider silk domain repeats were cloned in front of the CsgA signal sequence, which includes a Sec translocation sequence for periplasmic localization and the N22 sequence, which is a CsgG-specific signal for transport through the outer membrane. The transformants were grown and spotted onto LB plates containing Congo red, a red dye which has been shown to bind to silk, as illustrated in FIG. 4. See dos Santos-Pinto, J. R. A. et al. Structural Model for the Spider Silk Protein Spidroin-1. *J. Proteome Res.* 150811080734002 (2015) hereby incorporated by reference in its entirety. Since these silk domains are not tethered to the cell surface, one would expect to see a red halo around the spotted cells as the silk proteins diffuse through the agar and bind to the dye, especially for constructs of a lower molecular weight. This was observed for SS-Silk4 and, to a lesser extent, the SS-Silk8 spots. As depicted in FIG. 3A, Sec-N22-[Silk]$_N$-HisTag constructs are secreted by the *E. coli* T8SS pathway. SS-Silk constructs transformed into *E. coli* and plated onto Congo Red LB plates and induced with 0.05 mM IPTG. The negative control plasmid encodes for a non-CR binding protein, BSA. See FIGS. 3A and 3B. Various Sec-N22 secretion tag constructs were tested, as shown in Table 1. Various Sec-N22 amyloid-silk fusion constructs were tested, as shown in Table 2.

TABLE 1

SEC-N22 SECRETION TAG SILK CONSTRUCTS

| CONSTRUCT | GENE SIZE (BP) | PROTEIN SIZE (RESIDUES) | MOLECULAR WEIGHT (KDA) |
|---|---|---|---|
| SS-Silk4 | 474 | 198 | 17.29 |
| SS-Silk8 | 900 | 339 | 28.91 |
| SS-Silk16 | 1752 | 621 | 52.14 |
| SS-Silk32 | 3456 | 1185 | 98.61 |
| SS-Silk64 | 6864 | 2313 | 191.55 |

TABLE 2

SEC-N22 AMYLOID-SILK FUSION CONSTRUCTS

| CONSTRUCT | GENE SIZE (BP) | PROTEIN SIZE (RESIDUES) | MOLECULAR WEIGHT (KDA) |
|---|---|---|---|
| SS-Silk4 | 474 | 198 | 17.29 |
| SS-Silk8 | 900 | 339 | 28.91 |
| SS-Silk16 | 1752 | 621 | 52.14 |
| SS-Silk32 | 3456 | 1185 | 98.61 |
| SS-Silk64 | 6864 | 2313 | 191.55 |

EXAMPLE III

Expression of Spider Silk Domains as a Fusion to the CsgA Protein

Figure 5:
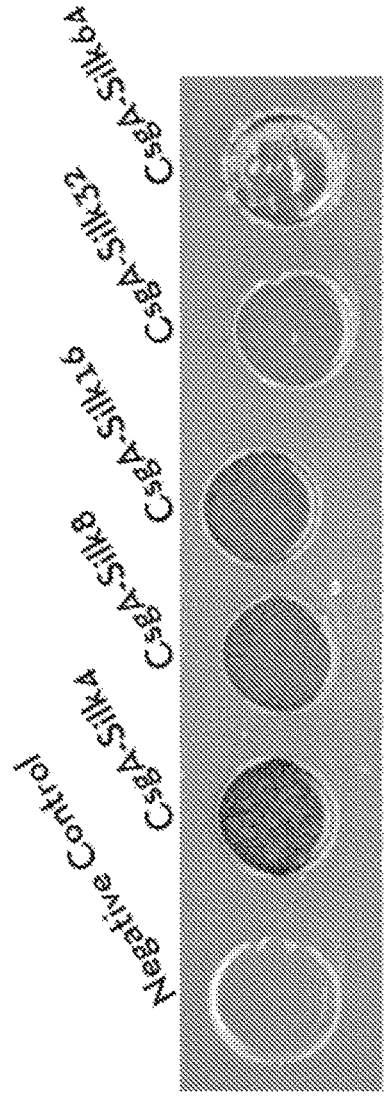
FIG. 5 illustrates that Sec-N22-CsgA-[Silk]$_N$-HisTag constructs are secreted by the *E. coli* T8SS pathway. SS-Silk constructs transformed into *E. coli* and plated onto Congo Red LB plates and induced with 0.05 mM IPTG. The negative control plasmid encodes for a non-CR binding protein, BSA.

To determine if silk-protein fused to different functional proteins could be secreted to generate a programmable silk material, CsgA-silk domain fusions were tested. As depicted in FIG. 3B, these constructs also contain the Sec-N22 T8SS secretion signal domains. These CsgA-silk fusions would assemble extracellularly into a hybrid amyloid-silk material. See FIG. 2. These constructs, when expressed in *E. coli* and spotted onto LB-CR plates, show clear Congo Red binding, indicating successful secretion of these silk-protein fusions. See FIG. 5.

FIG. 3B depicts the Sec-N22-CsgA-[Silk]$_N$-HisTag constructs secreted by the *E. coli* T8SS pathway. The fusion proteins were transformed into *E. coli* and plated onto Congo Red LB plates and induced with 0.05 mM IPTG. The negative control plasmid encodes for a non-CR binding protein, BSA. See FIGS. 3A and 3B.

EXAMPLE IV

Additional Applications

Aspects of the present disclosure utilize the modified bacterial cells which express a silk protein or a CsgA-silk fusion. Silks have been intensely researched for its potential use in a plethora of different applications. As it can be assembled into different forms (fibers, thin films, foams, etc.) the applications are likewise varied. Methods described herein decrease processing costs for silk proteins. A small sampling of the commercial applications for silk proteins products are listed in the table below. In addition, other anticipated applications of the disclosed production process may include: use in a manufacturing process for the production of various silk proteins for use in high performance textiles (e.g., sporting wear, protective armor, etc.), hydrogels, films, or foams, or biomedical devices. Use in combination with optimized curli secretion systems in other engineered strains of *E. coli*. In vivo production of silk-based materials (e.g., in the GI tract) for therapeutic or diagnostic purposes. Production of silk-based materials in agricultural settings, such as on the surface of leaves, plants, roots, or in soil. Uses are shown in Table 3.

TABLE 3

APPLICATIONS

| TYPE OF FABRICATION | MARKET | APPLICATION |
|---|---|---|
| Fibers | Industrial | Super-tough fabrics and composites[6, 18] |
| Fibers | Industrial | Large-scale 3D printed structures[1] |
| Fibers | Biomedical | Functionalized superior sutures and medical bandages[20, 21] |
| Fibers | Biomedical | Artificial biomimetic muscles[22] |
| Foams | Biomedical | Biomaterials for tissue bioengineering scaffolds[23, 24] |
| Foams | Biomedical | Injectable tetrahertz waveguides[25] |
| Thin Films | Industrial | Transparent photonic films[26] |
| Thin Films | Industrial/Biomedical | Biocompatible flexible electrodes[27] |
| Thin Films | Biomedical | Brain electrode coatings[28] |
| Thin Films | Biomedical | Drug storage and delivery[29] |
| Thin Films | Biomedical | Vaccine stabilization[30] |
| Thin Films | Biomedical | Antibiotic stabilization[30] |
| Thin Films | Biomedical | Virus stabilization[31] |
| Thin Films | Biomedical | Enzyme stabilization[32] |
| Films | Industrial/Biomedical | Microfluidic devices[33] |
| Particles/Spheres | Biomedical | Drug storage and delivery[34-36] |
| Particles/Spheres | Industrial | Battery energy storage materials[36] |

REFERENCES

Each of the following references is hereby incorporated by reference in its entirety.

1. Griffiths, J. R. & Salanitri, V. R. The strength of spider silk. *J. Mater. Sci.* 15, 491-496 (1980).
2. Gosline, J. M., Guerette, P. a, Ortlepp, C. S. & Savage, K. N. The mechanical design of spider silks: from fibroin sequence to mechanical function. *J. Exp. Biol.* 202, 3295-3303 (1999).
3. Huang, X., Liu, G. & Wang, X. New secrets of spider silk: Exceptionally high thermal conductivity and its abnormal change under stretching. *Adv. Mater.* 24, 1482-1486 (2012).
4. Guan, J., Vollrath, F. & Porter, D. Two mechanisms for supercontraction in Nephila spider dragline silk. *Biomacromolecules* 12, 4030-4035 (2011).
5. Fahnestock, S. R. & Irwin, S. L. Synthetic spider dragline silk proteins and their production in *Escherichia coli*. *Appl. Microbiol. Biotechnol.* 47, 23-32 (1997).
6. Xia, X.-X. et al. Native-sized recombinant spider silk protein produced in metabolically engineered *Escherichia coli* results in a strong fiber. *Proc. Natl. Acad. Sci.* 107, 14059-14063 (2010).
7. Widmaier, D. M. et al. Engineering the Salmonella type III secretion system to export spider silk monomers. *Mol. Syst. Biol.* 5, 1-9 (2009).
8. Fahnestock, S. R. & Bedzyk, L. A. Production of synthetic spider dragline silk protein in Pichia pastoris. *Appl. Microbiol. Biotechnol.* 47, 33-9 (1997).
9. Yang, J., Barr, L. A., Fahnestock, S. R. & Liu, Z.-B. High yield recombinant silk-like protein production in transgenic plants through protein targeting. *Transgenic Res.* 14, 313-24 (2005).
10. Lazaris, A. Spider Silk Fibers Spun from Soluble Recombinant Silk Produced in Mammalian Cells. *Science (80-.).* 295, 472-476 (2002).
11. Keten, S., Xu, Z., Ihle, B. & Buehler, M. J. Nanoconfinement controls stiffness, strength and mechanical toughness of β-sheet crystals in silk. *Nat. Mater.* 9, 359-367 (2010).
12. Nova, A., Keten, S., Pugno, N. M., Redaelli, A. & Buehler, M. J. Molecular and nanostructural mechanisms of deformation, strength and toughness of spider silk fibrils. *Nano Lett.* 10, 2626-34 (2010).
13. Chapman, M. R. et al. Role of *Escherichia coli* curli operons in directing amyloid fiber formation. *Science* 295, 851-855 (2002).
14. Desvaux, M., Hébraud, M., Talon, R. & Henderson, I. R. Secretion and subcellular localizations of bacterial proteins: a semantic awareness issue. *Trends Microbiol.* 17, 139-45 (2009).
15. Sivanathan, V. & Hochschild, A. Generating extracellular amyloid aggregates using *E. coli* cells. *Genes Dev.* 26, 2659-2667 (2012).
16. Widmaier, D. M. & Voigt, C. a. Quantification of the physiochemical constraints on the export of spider silk proteins by Salmonella type III secretion. *Microb. Cell Fact.* 9, 78 (2010).
17. dos Santos-Pinto, J. R. A. et al. Structural Model for the Spider Silk Protein Spidroin-1. *J. Proteome Res.* 150811080734002 (2015). doi:10.1021/acs.jproteome.5b00243.
18. Heidebrecht, A. et al. Biomimetic Fibers Made of Recombinant Spidroins with the Same Toughness as Natural Spider Silk. *Adv. Mater.* 4, 1-6 (2015).
19. Schacht, K. et al. Biofabrication of cell-loaded 3D spider silk constructs. *Angew. Chem. Int. Ed. Engl.* 54, 2816-20 (2015).
20. Chen, X. et al. Antibacterial Surgical Silk Sutures Using a High-Performance Slow-Release Carrier Coating System. *ACS Appl. Mater. Interfaces* 7, 22394-403 (2015).
21. Calamak, S., Erdogdu, C., Ozalp, M. & Ulubayram, K. Silk fibroin based antibacterial bionanotextiles as wound dressing materials. *Mater. Sci. Eng. C. Mater. Biol. Appl.* 43, 11-20 (2014).
22. Agnarsson, I., Dhinojwala, A., Sahni, V. & Blackledge, T. a. Spider silk as a novel high performance biomimetic muscle driven by humidity. *J. Exp. Biol.* 212, 1990-1994 (2009).
23. Wang, S., Ghezzi, C. E., White, J. D. & Kaplan, D. L. Coculture of dorsal root ganglion neurons and differentiated human corneal stromal stem cells on silk-based scaffolds. *J. Biomed. Mater. Res. A* 103, 3339-48 (2015).
24. Yao, D., Liu, H. & Fan, Y. Silk scaffolds for musculoskeletal tissue engineering. *Exp. Biol. Med. (Maywood).* (2015). doi:10.1177/1535370215606994.
25. Guerboukha, H., Yan, G., Skorobogata, O. & Skorobogatiy, M. Silk Foam Terahertz Waveguides. *Adv. Opt. Mater.* n/a-n/a (2014). doi:10.1002/adom.201400228.
26. Perry, H., Gopinath, A., Kaplan, D. L., Negro, L. D. & Omenetto, F. G. Nano- and micropatterning of optically transparent, mechanically robust, biocompatible silk fibroin films. *Adv. Mater.* 20, 3070-3072 (2008).
27. Kim, D.-H. et al. Dissolvable films of silk fibroin for ultrathin conformal bio-integrated electronics. *Nat. Mater.* 9, 511-7 (2010).
28. Tien, L. W. et al. Silk as a multifunctional biomaterial substrate for reduced glial scarring around brain-penetrating electrodes. *Adv. Funct. Mater.* 23, 3185-3193 (2013).
29. Yucel, T., Lovett, M. L. & Kaplan, D. L. Silk-based biomaterials for sustained drug delivery. *J. Control. Release* 190, 381-97 (2014).
30. Zhang, J. et al. Stabilization of vaccines and antibiotics in silk and eliminating the cold chain. *Proc. Natl. Acad. Sci. U.S.A.* 109, 11981-6 (2012).
31. Sutherland, T. D. et al. Stabilization of viruses by encapsulation in silk proteins. *ACS Appl. Mater. Interfaces* 6, 18189-96 (2014).
32. Lu, Q. et al. Stabilization and release of enzymes from silk films. *Macromol. Biosci.* 10, 359-68 (2010).
33. Bettinger, C. J. et al. Silk Fibroin Microfluidic Devices. *Adv. Mater.* 19, 2847-2850 (2007).
34. Tian, Y., Jiang, X., Chen, X., Shao, Z. & Yang, W. Doxorubicin-loaded magnetic silk fibroin nanoparticles for targeted therapy of multidrug-resistant cancer. *Adv. Mater.* 26, 7393-8 (2014).
35. Qu, J. et al. Silk fibroin nanoparticles prepared by electrospray as controlled release carriers of cisplatin. *Mater. Sci. Eng. C. Mater. Biol. Appl.* 44, 166-74 (2014).
36. Sheng, W. et al. Silk-regulated hierarchical hollow magnetite/carbon nanocomposite spheroids for lithium-ion battery anodes. *Nanotechnology* 26, 115603 (2015).

SEQUENCE LISTING (2074 sequences)

SEQ ID NO: 1 - protein, 11 aa, Artificial Sequence
  Synthetic peptide
GAGAAAAAGAG

SEQ ID NO: 2 - protein, 151 aa, Artificial Sequence
  Synthetic silk product using the T8SS bacterial functional amyloid secretion system
MKLLKVAAIAAIVFSGSALAGVVPQYGGGGNHGGGGNNSGPNSELNIYQYGGGNSALALQTDARNSDLTITQHGGGNGADVGQGSDDSSIDLTQRGFGNSATLDQWNGKNSEMTVKQFGGGNGAAVDQTASNSSVNVTQVGFGNNATAHQY

SEQ ID NO: 3 - protein, 35 aa, Nephila clavipes
  misc feature (1)..(35): silk domain repetitive sequence constructed from the Golden Silk Orb-weaving spider Nephila clavipes
GRGGLGGQGAGMAAAAAMGGAGQGGYGGLGSQGTS

SEQ ID NO: 4 - protein, 150 aa, Escherichia coli
  misc feature (1)..(150): E. coli CsgA polypeptide
MKLLKVAAIAAIVFSGSALAGVVPQYGGGGNHGGGGNNSGPNSELNIYQYGGGNSALALQTDARNSDLTITQHGGGNGADVGQGSDDSSIDLTQRGFGNSATLDQWNGKNSEMTVKQFGGGNGAAVDQTASNSSVNVTQVGFGNNATAHQ

SEQ ID NO: 5 - protein, 5 aa, Escherichia coli
  misc feature (1)..(5): Exemplary sequence for an elastin-like protein
  misc feature (4)..(4): Xaa can be any naturally occurring amino acid
VPVXG

SEQ ID NO: 6 - protein, 6 aa, Artificial Sequence
  Synthetic peptide
GAGAGS

SEQ ID NO: 7 - protein, 5 aa, Artificial Sequence
  Synthetic peptide
GVGVP

SEQ ID NO: 8 - protein, 5 aa, Artificial Sequence
  Synthetic peptide
  misc feature (4)..(4): Xaa can be any naturally occurring amino acid
GPGXY

SEQ ID NO: 9 - protein, 31 aa, Nephila clavipes
  misc feature (1)..(31): sequence shown in Fig. 3A
GRGGLGGQGAGMAAAAAMGGAGQGGYGGLGS

SEQ ID NO: 10 - protein, 2 aa, Escherichia coli
  misc feature (1)..(2): Escherichia coli Q9L6T6 Q9L6T6 ECOLX
LA

SEQ ID NO: 11 - protein, 3 aa, Escherichia coli
  misc feature (1)..(3): Escherichia coli Q708I8 Q708I8 ECOLX
AHA

SEQ ID NO: 12 - protein, 3 aa, Escherichia coli
  misc feature (1)..(3): Escherichia coli Q708I0 Q708I0 ECOLX
AHA

SEQ ID NO: 13 - protein, 3 aa, Escherichia coli
  misc feature (1)..(3): Escherichia coli Q708H0 Q708H0 ECOLX
AHA

SEQ ID NO: 14 - protein, 3 aa, Escherichia coli
  misc feature (1)..(3): Escherichia coli Q708H5 Q708H5 ECOLX
AHA

SEQ ID NO: 15 - protein, 3 aa, Escherichia coli
  misc feature (1)..(3): Escherichia coli Q708H4 Q708H4 ECOLX
AHA

SEQ ID NO: 16 - protein, 3 aa, Escherichia coli
  misc feature (1)..(3): Escherichia coli Q708I2 Q708I2 ECOLX
AHA

SEQ ID NO: 17 - protein, 3 aa, Escherichia coli
  misc feature (1)..(3): Escherichia coli Q708H2 Q708H2 ECOLX
AHA

SEQ ID NO: 18 - protein, 3 aa, Escherichia coli
  misc feature (1)..(3): Escherichia coli Q708I4 Q708I4 ECOLX
AHA

SEQ ID NO: 19 - protein, 10 aa, Escherichia coli
  misc feature (1)..(10): Escherichia coli P71221 P71221 ECOLX
MAVVSFGANA

SEQ ID NO: 20 - protein, 10 aa, Escherichia coli
  misc feature (1)..(10): Escherichia coli P71219 P71219 ECOLX
MAVVSFGVNA

SEQ ID NO: 21 - protein, 10 aa, Escherichia coli
  misc feature (1)..(10): Escherichia coli Q9K343 Q9K343 ECOLX
MFKTTLCALL

SEQ ID NO: 22 - protein, 10 aa, Escherichia coli
  misc feature (1)..(10): Escherichia coli P71222 P71222 ECOLX
MAVVSFGAYA

SEQ ID NO: 23 - protein, 10 aa, Escherichia coli
  misc feature (1)..(10): Escherichia coli P71218 P71218 ECOLX
MAVVSFGANA

SEQ ID NO: 24 - protein, 11 aa, Escherichia coli
  misc feature (1)..(11): Escherichia coli O6:K15:H31 (strain 536/UPEC) Q0TBP2 YSAB ECOL5
MALMVLMALVG

SEQ ID NO: 25 - protein, 12 aa, Escherichia coli
  misc feature (1)..(12): Escherichia coli (strain K12) Q9JMS5 YUAO ECOLI
MCFFLGSRLAYA

SEQ ID NO: 26 - protein, 15 aa, Escherichia coli
  misc feature (1)..(15): Escherichia coli O157:H7 P64513 MGRB ECO57
MKKFRWVVLVVVVLA

SEQ ID NO: 27 - protein, 15 aa, Escherichia coli
  misc feature (1)..(15): Escherichia coli (strain UTI89/UPEC) Q1RAW2 MGRB ECOUT
MKKFRWVALVVVVLA

SEQ ID NO: 28 - protein, 15 aa, Escherichia coli
  misc feature (1)..(15): Escherichia coli (strain K12) P64512 MGRB ECOLI
MKKFRWVVLVVVVLA

SEQ ID NO: 29 - protein, 15 aa, Escherichia coli
  misc feature (1)..(15): Escherichia coli (strain K12) P45527 YHBU ECOLI
MELLCPAGNLPALKA

SEQ ID NO: 30 - protein, 15 aa, Escherichia coli
  misc feature (1)..(15): Escherichia coli (strain K12) P0AEA2 CSGG ECOLI
MQRLFLLVAVMLLSG

SEQ ID NO: 31 - protein, 15 aa, Escherichia coli
  misc feature (1)..(15): Escherichia coli O157:H7 P0AEA4 CSGG ECO57
MQRLFLLVAVMLLSG

SEQ ID NO: 32 - protein, 15 aa, Escherichia coli
  misc feature (1)..(15): Escherichia coli (strain K12) P0AB10 YMBA ECOLI
MKKWLVTIAALWLAG

SEQ ID NO: 33 - protein, 15 aa, Escherichia coli
  misc feature (1)..(15): Escherichia coli (strain UTI89/UPEC) Q1RCQ2 EMTA ECOUT
MKLRWFAFLIVLLAG

SEQ ID NO: 34 - protein, 15 aa, Escherichia coli
  misc feature (1)..(15): Escherichia coli (strain ATCC 8739/DSM 1576/Crooks) B1IU99 EMTA ECOLC
MKLRWFAFLIVLLAG

SEQ ID NO: 35 - protein, 15 aa, Escherichia coli
  misc feature (1)..(15): Escherichia coli O6:K15:H31 (strain 536/UPEC) Q0TJQ3 YBHG ECOL5
MKKPVVIGLAVVVLA

SEQ ID NO: 36 - protein, 15 aa, Escherichia coli
  misc feature (1)..(15): Escherichia coli O6 P0AEA3 CSGG ECOL6
MQRLFLLVAVMLLSG

SEQ ID NO: 37 - protein, 15 aa, Escherichia coli
  misc feature (1)..(15): Escherichia coli O9:H4 (strain HS) A8A123 MGRB ECOHS
MKKFRWVVLVVVVLA

SEQ ID NO: 38 - protein, 15 aa, Escherichia coli
  misc feature (1)..(15): Escherichia coli (strain K12) P23898 NLPC ECOLI
MRFCLILITALLLAG

SEQ ID NO: 39 - protein, 15 aa, Escherichia coli
  misc feature (1)..(15): Escherichia coli (strain K12) P32687 YJBF ECOLI
MKRPALILICLLLQA

SEQ ID NO: 40 - protein, 15 aa, Escherichia coli
  misc feature (1)..(15): Escherichia coli O139:H28 (strain E24377A/ETEC) A7ZJK6 YBHG ECO24
MKKPVVIGLAVVVLA

SEQ ID NO: 41 - protein, 15 aa, Escherichia coli
  misc feature (1)..(15): Escherichia coli O6 P0AEZ8 MLTD ECOL6
MKAKAILLASVLLVG

SEQ ID NO: 42 - protein, 15 aa, Escherichia coli
  misc feature (1)..(15): Escherichia coli (strain K12) P37683 YIAV ECOLI
MDLLIILTYVAFAWA

SEQ ID NO: 43 - protein, 15 aa, Escherichia coli
  misc feature (1)..(15): Escherichia coli (strain K12) P0AEZ7 MLTD ECOLI
MKAKAILLASVLLVG

SEQ ID NO: 44 - protein, 15 aa, Escherichia coli
  misc feature (1)..(15): Escherichia coli O6:K15:H31 (strain 536/UPEC) P0C7B3 MGRB ECOL5
MKKFRWVALVVVVLA

SEQ ID NO: 45 - protein, 15 aa, Escherichia coli
  misc feature (1)..(15): Escherichia coli (strain ATCC 8739/DSM 1576/Crooks) B1IXH3 YBHG ECOLC
MKKPVVIGLAVVVLA

SEQ ID NO: 46 - protein, 15 aa, Escherichia coli
  misc feature (1)..(15): Escherichia coli O1:K1/APEC A1AAB6 EMTA ECOK1
MKLRWFAFLIVLLAG

SEQ ID NO: 47 - protein, 15 aa, Escherichia coli
  misc feature (1)..(15): Escherichia coli (strain ATCC 8739/DSM 1576/Crooks) B1J0R3 MGRB ECOLC
MKKFRWVVLVVVVLA

SEQ ID NO: 48 - protein, 15 aa, Escherichia coli
  misc feature (1)..(15): Escherichia coli Q46670 CDTC ECOLX
MKKLAIVFTMLLIAG

SEQ ID NO: 49 - protein, 15 aa, Escherichia coli
  misc feature (1)..(15): Escherichia coli O1:K1/APEC P0C7B2 MGRB ECOK1
MKKFRWVALVVVVLA

SEQ ID NO: 50 - protein, 15 aa, Escherichia coli
  misc feature (1)..(15): Escherichia coli (strain K12) P39349 YJGX ECOLI
MNRPVFPVYHFLVSA

SEQ ID NO: 51 - protein, 15 aa, Escherichia coli
  misc feature (1)..(15): Escherichia coli (strain K12) P76009 EMTA ECOLI
MKLRWFAFLIVLLAG

SEQ ID NO: 52 - protein, 15 aa, Escherichia coli
  misc feature (1)..(15): Escherichia coli O6 P59243 EMTA ECOL6
MKLRWFAFLIVLLAG

SEQ ID NO: 53 - protein, 15 aa, Escherichia coli
  misc feature (1)..(15): Escherichia coli O6 Q8FGT7 MGRB ECOL6
MKKFRWVALVVVVLA

SEQ ID NO: 54 - protein, 15 aa, Escherichia coli
  misc feature (1)..(15): Escherichia coli (strain K12) P31063 YEDD ECOLI
MKKLAIAGALLLLAG

SEQ ID NO: 55 - protein, 15 aa, Escherichia coli
  misc feature (1)..(15): Escherichia coli O9:H4 (strain HS) A7ZY51 YBHG ECOHS
MKKPVVIGLAVVVLA

SEQ ID NO: 56 - protein, 15 aa, Escherichia coli
  misc feature (1)..(15): Escherichia coli O157:H7 Q8XDJ7 EMTA ECO57
MKLRWFAFLIVLLAG

SEQ ID NO: 57 - protein, 15 aa, Escherichia coli
  misc feature (1)..(15): Escherichia coli (strain K12) P75884 GFCB ECOLI
MRPLILSIFALFLAG

SEQ ID NO: 58 - protein, 15 aa, Escherichia coli
  misc feature (1)..(15): Escherichia coli O6:K15:H31 (strain 536/UPEC) Q0TII2 EMTA ECOL5
MKLRWFAFLIVLLAG

SEQ ID NO: 59 - protein, 15 aa, Escherichia coli
  misc feature (1)..(15): Escherichia coli O139:H28 (strain E24377A/ETEC) A7ZMU8 MGRB ECO24
MKKFRWVVLVVVVLA

SEQ ID NO: 60 - protein, 16 aa, Escherichia coli
  misc feature (1)..(16): Escherichia coli O1:K1/APEC A1A936 YBHG ECOK1
MMKKPVVIGLAVVVLA

SEQ ID NO: 61 - protein, 16 aa, Escherichia coli
  misc feature (1)..(16): Escherichia coli O6 Q8FHC4 YNFC ECOL6
MKYKLLPCLLAILLTG

SEQ ID NO: 62 - protein, 16 aa, Escherichia coli
  misc feature (1)..(16): Escherichia coli Q46999 TRAK2 ECOLX
MRKNNTAIIFGGLFFS

SEQ ID NO: 63 - protein, 16 aa, Escherichia coli
  misc feature (1)..(16): Escherichia coli (strain K12) P76297 FLHE ECOLI
MRTLLAILLFPLLVQA

SEQ ID NO: 64 - protein, 16 aa, Escherichia coli
  misc feature (1)..(16): Escherichia coli O6 Q8FJN6 YBHG ECOL6
MMKKPVVIGLAVVVLA

SEQ ID NO: 65 - protein, 16 aa, Escherichia coli
  misc feature (1)..(16): Escherichia coli O9:H4 (strain HS) A8A4A6 MLTC ECOHS
MKKYLALALIAPLLIS

SEQ ID NO: 66 - protein, 16 aa, Escherichia coli
  misc feature (1)..(16): Escherichia coli O139:H28 (strain E24377A/ETEC) A7ZR89 MLTC ECO24
MKKYLALALIAPLLIS

SEQ ID NO: 67 - protein, 16 aa, Escherichia coli
  misc feature (1)..(16): Escherichia coli O6 P0C067 MLTC ECOL6
MKKYLALALIAPLLIS

SEQ ID NO: 68 - protein, 16 aa, Escherichia coli
  misc feature (1)..(16): Escherichia coli (strain K12) P67553 YNFC ECOLI
MKYKLLPCLLAIFLTG

SEQ ID NO: 69 - protein, 16 aa, Escherichia coli
  misc feature (1)..(16): Escherichia coli O1:K1/APEC A1AFE9 MLTC ECOK1
MKKYLALALIAPLLIS

SEQ ID NO: 70 - protein, 16 aa, Escherichia coli
  misc feature (1)..(16): Escherichia coli (strain ATCC 8739/DSM 1576/Crooks) B1ISK6 MLTC ECOLC
MKKYLALALIAPLLIS

SEQ ID NO: 71 - protein, 16 aa, Escherichia coli
  misc feature (1)..(16): Escherichia coli (strain K12) P76540 EUTK ECOLI
MINALGLLEVDGMVAA

SEQ ID NO: 72 - protein, 16 aa, Escherichia coli
  misc feature (1)..(16): Escherichia coli (strain K12) P77330 BORD ECOLI
MKKMLLATALALLITG

SEQ ID NO: 73 - protein, 16 aa, Escherichia coli
  misc feature (1)..(16): Escherichia coli O6 P0AB59 YCIM ECOL6
MLELLFLLLPVAAAYG

SEQ ID NO: 74 - protein, 16 aa, Escherichia coli
  misc feature (1)..(16): Escherichia coli (strain UTI89/UPEC) Q1R762 MLTC ECOUT
MKKYLALALIAPLLIS

SEQ ID NO: 75 - protein, 16 aa, Escherichia coli
  misc feature (1)..(16): Escherichia coli O157:H7 Q8X7Y9 YBHG ECO57
MMKKPVVIGLAVVVLA

SEQ ID NO: 76 - protein, 16 aa, Escherichia coli
  misc feature (1)..(16): Escherichia coli (strain ATCC 8739/DSM 1576/Crooks) B1IZA0 B1IZA0 ECOLC
MPFLFLVLLTFRAAAA

SEQ ID NO: 77 - protein, 16 aa, Escherichia coli
  misc feature (1)..(16): Escherichia coli (strain K12) P75777 YBHG ECOLI
MMKKPVVIGLAVVVLA

SEQ ID NO: 78 - protein, 16 aa, Escherichia coli
  misc feature (1)..(16): Escherichia coli (strain K12) P55140 YGCG ECOLI
MRYFILMFTFVCSFVA

SEQ ID NO: 79 - protein, 16 aa, Escherichia coli
  misc feature (1)..(16): Escherichia coli (strain K12) P75820 AMID ECOLI
MRRFFWLVAAALLLAG

SEQ ID NO: 80 - protein, 16 aa, Escherichia coli
  misc feature (1)..(16): Escherichia coli (strain K12) P0C066 MLTC ECOLI
MKKYLALALIAPLLIS

SEQ ID NO: 81 - protein, 16 aa, Escherichia coli
  misc feature (1)..(16): Escherichia coli Q46971 MTFS ECOLX
MYMRELDREELNCVGG

SEQ ID NO: 82 - protein, 16 aa, Escherichia coli
  misc feature (1)..(16): Escherichia coli (strain K12) P75734 YBFN ECOLI
MKKLILIAIMASGLVA

SEQ ID NO: 83 - protein, 16 aa, Escherichia coli
  misc feature (1)..(16): Escherichia coli (strain K12) P0AB58 YCIM ECOLI
MLELLFLLLPVAAAYG

SEQ ID NO: 84 - protein, 16 aa, Escherichia coli
  misc feature (1)..(16): Escherichia coli O157:H7 P0AB60 YCIM ECO57
MLELLFLLLPVAAAYG

SEQ ID NO: 85 - protein, 16 aa, Escherichia coli
  misc feature (1)..(16): Escherichia coli O6:K15:H31 (strain 536/UPEC) Q0TDN8 MLTC ECOL5
MKKYLALALIAPLLIS

SEQ ID NO: 86 - protein, 16 aa, Escherichia coli
  misc feature (1)..(16): Escherichia coli (strain K12) P41066 TRAK1 ECOLI
MRKNNTAIIFGSLFFS

SEQ ID NO: 87 - protein, 16 aa, Escherichia coli
  misc feature (1)..(16): Escherichia coli O157:H7 Q8X799 YNFC ECO57
MKYKLLPCLLAILLTG

SEQ ID NO: 88 - protein, 16 aa, Escherichia coli
  misc feature (1)..(16): Escherichia coli (strain UTI89/UPEC) Q1RED2 YBHG ECOUT
MMKKPVVIGLAVVVLA

SEQ ID NO: 89 - protein, 16 aa, Escherichia coli
  misc feature (1)..(16): Escherichia coli O6:K15:H31 (strain 536/UPEC) Q0THN9 YNFC ECOL5
MKYKLLPCLLAILLTG

SEQ ID NO: 90 - protein, 16 aa, Escherichia coli
  misc feature (1)..(16): Escherichia coli O157:H7 Q8XCS6 MLTC ECO57
MKKYLALALIAPLLIS

SEQ ID NO: 91 - protein, 17 aa, Escherichia coli
  misc feature (1)..(17): Escherichia coli (strain K12) P33668 YBBC ECOLI
MKYSSIFSMLSFFILFA

SEQ ID NO: 92 - protein, 17 aa, Escherichia coli
  misc feature (1)..(17): Escherichia coli O6 P0ADA6 YAJG ECOL6
MFKKILFPLVALFMLAG

SEQ ID NO: 93 - protein, 17 aa, Escherichia coli
  misc feature (1)..(17): Escherichia coli O157:H7 P58320 DSBG ECO57
MLKKILLLALLPAIAFA

SEQ ID NO: 94 - protein, 17 aa, Escherichia coli
  misc feature (1)..(17): Escherichia coli O111:H- Q9S142 BFPB ECO11
MKLGRYSLFLLCPLLAS

SEQ ID NO: 95 - protein, 17 aa, Escherichia coli
  misc feature (1)..(17): Escherichia coli (strain K12) Q47151 YAFL ECOLI
MSLPSIPSFVLSGLLLI

SEQ ID NO: 96 - protein, 17 aa, Escherichia coli
  misc feature (1)..(17): Escherichia coli P25731 CSOB ECOLX
MRKLFLSLLMIPFVAKA

SEQ ID NO: 97 - protein, 17 aa, Escherichia coli
  misc feature (1)..(17): Escherichia coli (strain K12) P75860 YCBV ECOLI
MLKRIIWILFLLGLTWG

SEQ ID NO: 98 - protein, 17 aa, Escherichia coli
  misc feature (1)..(17): Escherichia coli O6 Q8FCE8 YSAB ECOL6
MMMNAFFPAMALIVLVG

SEQ ID NO: 99 - protein, 17 aa, Escherichia coli
  misc feature (1)..(17): Escherichia coli O157:H7 P0A906 SLYB ECO57
MIKRVLVVSMVGLSLVG

SEQ ID NO: 100 - protein, 17 aa, Escherichia coli
  misc feature (1)..(17): Escherichia coli (strain K12) P0A905 SLYB ECOLI
MIKRVLVVSMVGLSLVG

SEQ ID NO: 101 - protein, 17 aa, Escherichia coli
  misc feature (1)..(17): Escherichia coli P09181 LYS4 ECOLX
MCGKILLILFFIMTLSA

SEQ ID NO: 102 - protein, 17 aa, Escherichia coli
  misc feature (1)..(17): Escherichia coli (strain K12) P77202 DSBG ECOLI
MLKKILLLALLPAIAFA

SEQ ID NO: 103 - protein, 17 aa, Escherichia coli
  misc feature (1)..(17): Escherichia coli (strain K12) P25718 AMY1 ECOLI
MKLAACFLTLLPGFAVA

SEQ ID NO: 104 - protein, 17 aa, Escherichia coli
  misc feature (1)..(17): Escherichia coli (strain K12) Q2M7M3 YSAB ECOLI
MMMNAFFPAMALMVLVG

SEQ ID NO: 105 - protein, 17 aa, Escherichia coli
  misc feature (1)..(17): Escherichia coli (strain ATCC 8739/DSM 1576/Crooks) B1J0L0 B1J0L0 ECOLC
MRTLLAILLFPLLVQAA

SEQ ID NO: 106 - protein, 17 aa, Escherichia coli
  misc feature (1)..(17): Escherichia coli O157:H7 P0AF57 YJCO ECO57
MKKIIALMLFLTFFAHA

SEQ ID NO: 107 - protein, 17 aa, Escherichia coli
  misc feature (1)..(17): Escherichia coli (strain K12) P32689 YJBH ECOLI
MKKRHLLSLLALGISTA

SEQ ID NO: 108 - protein, 17 aa, Escherichia coli
  misc feature (1)..(17): Escherichia coli (strain K12) P10100 RLPA ECOLI
MRKQWLGICIAAGMLAA

SEQ ID NO: 109 - protein, 17 aa, Escherichia coli
  misc feature (1)..(17): Escherichia coli P05821 LYS3 ECOLX
MRKRFFVGIFAINLLVG

SEQ ID NO: 110 - protein, 17 aa, Escherichia coli
  misc feature (1)..(17): Escherichia coli O157:H7 O82903 YUBK ECO57
MCPECFFLMLFFCGYRA

SEQ ID NO: 111 - protein, 17 aa, Escherichia coli
  misc feature (1)..(17): Escherichia coli O127:H6 Q47068 BFPB ECO27
MKLGRYSLFLLCPLLAS

SEQ ID NO: 112 - protein, 17 aa, Escherichia coli
  misc feature (1)..(17): Escherichia coli (strain K12) Q9JMR4 YUBK ECOLI
MCPECFFLMLFFCGYRA

SEQ ID NO: 113 - protein, 17 aa, Escherichia coli
  misc feature (1)..(17): Escherichia coli (strain K12) Q46898 YGCI ECOLI
MRSYLILRLAGPMQAWG

SEQ ID NO: 114 - protein, 17 aa, Escherichia coli
  misc feature (1)..(17): Escherichia coli O6 Q8CWA4 CUSC ECOL6
MSPCKLLPFCVALALTG

SEQ ID NO: 115 - protein, 17 aa, Escherichia coli
  misc feature (1)..(17): Escherichia coli (strain K12) P77211 CUSC ECOLI
MSPCKLLPFCVALALTG

SEQ ID NO: 116 - protein, 17 aa, Escherichia coli
  misc feature (1)..(17): Escherichia coli (strain K12) P0ADA5 YAJG ECOLI
MFKKILFPLVALFMLAG

SEQ ID NO: 117 - protein, 17 aa, Escherichia coli
  misc feature (1)..(17): Escherichia coli O157:H7 Q8X4J1 YSAB ECO57
MMMNSFFPAMALMVLVG

SEQ ID NO: 118 - protein, 17 aa, Escherichia coli
  misc feature (1)..(17): Escherichia coli (strain K12) P0AF56 YJCO ECOLI
MKKIIALMLFLTFFAHA

SEQ ID NO: 119 - protein, 17 aa, Escherichia coli
  misc feature (1)..(17): Escherichia coli O157:H7 Q8XBQ1 RLPA ECO57
MRKQWLGICIAAGMLAA

SEQ ID NO: 120 - protein, 17 aa, Escherichia coli
  misc feature (1)..(17): Escherichia coli (strain K12) P76578 YFHM ECOLI
MKKLRVAACMLMLALAG

SEQ ID NO: 121 - protein, 17 aa, Escherichia coli
  misc feature (1)..(17): Escherichia coli O157:H7 Q8XBY3 CUSC ECO57
MSPCKLLPFCVALALTG

SEQ ID NO: 122 - protein, 17 aa, Escherichia coli
  misc feature (1)..(17): Escherichia coli (strain K12) P52107 CSGC ECOLI
MNTLLLLAALSSQITFN

SEQ ID NO: 123 - protein, 17 aa, Escherichia coli
  misc feature (1)..(17): Escherichia coli (strain K12) P76506 VACJ ECOLI
MKLRLSALALGTTLLVG

SEQ ID NO: 124 - protein, 17 aa, Escherichia coli
  misc feature (1)..(17): Escherichia coli (strain K12) P0ADX7 YHHA ECOLI
MKRLLILTALLPFVGFA

SEQ ID NO: 125 - protein, 17 aa, Escherichia coli
  misc feature (1)..(17): Escherichia coli (strain UTI89/UPEC) Q1R535 YSAB ECOUT
MMMNAFFPAMALIVLVG

SEQ ID NO: 126 - protein, 18 aa, Escherichia coli
  misc feature (1)..(18): Escherichia coli (strain ATCC 8739/DSM 1576/Crooks) B1J0I2 B1J0I2 ECOLC
MKRLLILTALLPFVGFAQ

SEQ ID NO: 127 - protein, 18 aa, Escherichia coli
  misc feature (1)..(18): Escherichia coli (strain ATCC 8739/DSM 1576/Crooks) B1IWU5 B1IWU5 ECOLC
MTRALALVAALALVALGW

SEQ ID NO: 128 - protein, 18 aa, Escherichia coli
  misc feature (1)..(18): Escherichia coli P42187 PRSF ECOLX
MIRLSLFISLLLTSVAVL

SEQ ID NO: 129 - protein, 18 aa, Escherichia coli
  misc feature (1)..(18): Escherichia coli (strain UTI89/UPEC) Q1RES0 RLPB ECOUT
MRYLATLLLSLAVLITAG

SEQ ID NO: 130 - protein, 18 aa, Escherichia coli
  misc feature (1)..(18): Escherichia coli (strain K12) P32051 YDEK ECOLI
MNRIYRVIWNCTLQVFQA

SEQ ID NO: 131 - protein, 18 aa, Escherichia coli
  misc feature (1)..(18): Escherichia coli (strain K12) P07021 YFIB ECOLI
MIKHLVAPLVFTSLILTG

SEQ ID NO: 132 - protein, 18 aa, Escherichia coli
  misc feature (1)..(18): Escherichia coli (strain K12) P38683 TORT ECOLI
MRVLLFLLLSLFMLPAFS

SEQ ID NO: 133 - protein, 18 aa, Escherichia coli
  misc feature (1)..(18): Escherichia coli (strain K12) P0AB26 YCEB ECOLI
MNKFLFAAALIVSGLLVG

SEQ ID NO: 134 - protein, 18 aa, Escherichia coli
  misc feature (1)..(18): Escherichia coli P53509 CSSA2 ECOLX
MKKTIGLILILASFGSHA

SEQ ID NO: 135 - protein, 18 aa, Escherichia coli
  misc feature (1)..(18): Escherichia coli P53508 CSSA1 ECOLX
MKKTIGLILILASFGSHA

SEQ ID NO: 136 - protein, 18 aa, Escherichia coli
  misc feature (1)..(18): Escherichia coli (strain K12) P75818 YBJP ECOLI
MRYSKLTMLIPCALLLSA

SEQ ID NO: 137 - protein, 18 aa, Escherichia coli
  misc feature (1)..(18): Escherichia coli (strain K12) Q46858 YQHG ECOLI
MKIILLFLAALASFTVHA

SEQ ID NO: 138 - protein, 18 aa, Escherichia coli
  misc feature (1)..(18): Escherichia coli (strain K12) P41052 MLTB ECOLI
MFKRRYVTLLPLFVLLAA

SEQ ID NO: 139 - protein, 18 aa, Escherichia coli
  misc feature (1)..(18): Escherichia coli (strain K12) P31550 THIB ECOLI
MLKKCLPLLLLCTAPVFA

SEQ ID NO: 140 - protein, 18 aa, Escherichia coli
  misc feature (1)..(18): Escherichia coli O157:H7 P0AFB3 NLPI ECO57
MKPFLRWCFVATALTLAG

SEQ ID NO: 141 - protein, 18 aa, Escherichia coli
  misc feature (1)..(18): Escherichia coli (strain ATCC 8739/DSM 1576/Crooks) B1IZM1 B1IZM1 ECOLC
MKLAACFLTLLPGFAVAA

SEQ ID NO: 142 - protein, 18 aa, Escherichia coli
  misc feature (1)..(18): Escherichia coli (strain ATCC 8739/DSM 1576/Crooks) B1IYK1 B1IYK1 ECOLC
MLKKILLLALLPAIAFAE

SEQ ID NO: 143 - protein, 18 aa, Escherichia coli
  misc feature (1)..(18): Escherichia coli Q47116 Q47116 ECOLX
MKILLFVILFFNVFAASA

SEQ ID NO: 144 - protein, 18 aa, Escherichia coli
  misc feature (1)..(18): Escherichia coli (strain K12) P0ADB4 ECNA ECOLI
MMKRLIVLVLLASTLLTG

SEQ ID NO: 145 - protein, 18 aa, Escherichia coli
  misc feature (1)..(18): Escherichia coli (strain K12) P37194 SLP ECOLI
MNMTKGALILSLSFLLAA

SEQ ID NO: 146 - protein, 18 aa, Escherichia coli
  misc feature (1)..(18): Escherichia coli Q548U6 Q548U6 ECOLX
MKNITFIFFILLASPLYA

SEQ ID NO: 147 - protein, 18 aa, Escherichia coli
  misc feature (1)..(18): Escherichia coli (strain K12) P41069 TRAV ECOLI
MKQTSFFIPLLGTLLLYG

SEQ ID NO: 148 - protein, 18 aa, Escherichia coli
  misc feature (1)..(18): Escherichia coli (strain K12) P18472 TRAW ECOLI
MRCRGLIALLIWGQSVAA

SEQ ID NO: 149 - protein, 18 aa, Escherichia coli
  misc feature (1)..(18): Escherichia coli (strain K12) P77339 YAFT ECOLI
MNSKKLCCICVLFSLLAG

SEQ ID NO: 150 - protein, 18 aa, Escherichia coli
  misc feature (1)..(18): Escherichia coli (strain ATCC 8739/DSM 1576/Crooks) B1ITY2 B1ITY2 ECOLC
MKKIIALMLFLTFFAHAN

SEQ ID NO: 151 - protein, 18 aa, Escherichia coli
  misc feature (1)..(18): Escherichia coli (strain ATCC 8739/DSM 1576/Crooks) B1IYG7 RLPB ECOLC
MRYLATLLLSLAVLITAG

SEQ ID NO: 152 - protein, 18 aa, Escherichia coli
  misc feature (1)..(18): Escherichia coli (strain K12) P0A901 BLC ECOLI
MRLLPLVAAATAAFLVVA

SEQ ID NO: 153 - protein, 18 aa, Escherichia coli
  misc feature (1)..(18): Escherichia coli O157:H7 P0A902 BLC ECO57
MRLLPLVAAATAAFLVVA

SEQ ID NO: 154 - protein, 18 aa, Escherichia coli
  misc feature (1)..(18): Escherichia coli Q47115 Q47115 ECOLX
MKKIFIFLSIIFSAVVSA

SEQ ID NO: 155 - protein, 18 aa, Escherichia coli
  misc feature (1)..(18): Escherichia coli P06717 ELAP ECOLX
MKNITFIFFILLASPLYA

SEQ ID NO: 156 - protein, 18 aa, Escherichia coli
  misc feature (1)..(18): Escherichia coli O139:H28 (strain E24377A/ETEC) A7ZJ30 RLPB ECO24
MRYLATLLLSLAVLITAG

SEQ ID NO: 157 - protein, 18 aa, Escherichia coli
  misc feature (1)..(18): Escherichia coli O157:H7 P0ADB6 ECNA ECO57
MMKRLIVLVLLASTLLTG

SEQ ID NO: 158 - protein, 18 aa, Escherichia coli
  misc feature (1)..(18): Escherichia coli O157:H7 P58358 TORT ECO57
MRVLLFLLLSLFMLPAFS

SEQ ID NO: 159 - protein, 18 aa, Escherichia coli
  misc feature (1)..(18): Escherichia coli Q03038 Q03038 ECOLX
MKKIFVAALFAFVSVNAM

SEQ ID NO: 160 - protein, 18 aa, Escherichia coli
  misc feature (1)..(18): Escherichia coli (strain K12) P32668 YIJF ECOLI
MKASLALLSLLTAFTSHS

SEQ ID NO: 161 - protein, 18 aa, Escherichia coli
  misc feature (1)..(18): Escherichia coli Q2HQJ7 Q2HQJ7 ECOLX
MKNITFIFFILLASPLYA

SEQ ID NO: 162 - protein, 18 aa, Escherichia coli
  misc feature (1)..(18): Escherichia coli O6 P0ADB5 ECNA ECOL6
MMKRLIVLVLLASTLLTG

SEQ ID NO: 163 - protein, 18 aa, Escherichia coli
  misc feature (1)..(18): Escherichia coli (strain K12) P0AF78 YJFJ ECOLI
MGILKSLFTLGKSFISQA

SEQ ID NO: 164 - protein, 18 aa, Escherichia coli
  misc feature (1)..(18): Escherichia coli O157:H7 Q8XBN9 RLPB ECO57
MRYLATLLLSLAVLITAG

SEQ ID NO: 165 - protein, 18 aa, Escherichia coli
  misc feature (1)..(18): Escherichia coli (strain K12) P77717 YBAY ECOLI
MKLVHMASGLAVAIALAA

SEQ ID NO: 166 - protein, 18 aa, Escherichia coli
  misc feature (1)..(18): Escherichia coli O6 P0AFB2 NLPI ECOL6
MKPFLRWCFVATALTLAG

SEQ ID NO: 167 - protein, 18 aa, Escherichia coli
  misc feature (1)..(18): Escherichia coli P08408 PAPF ECOLX
MIRLSLFISLLLTSVAVL

SEQ ID NO: 168 - protein, 18 aa, Escherichia coli
  misc feature (1)..(18): Escherichia coli (strain K12) O32528 YPDI ECOLI
MKVNLILFSLFLLVSIMA

SEQ ID NO: 169 - protein, 18 aa, Escherichia coli
  misc feature (1)..(18): Escherichia coli Q47119 Q47119 ECOLX
MKKVIFVLSMFLCSQVYG

SEQ ID NO: 170 - protein, 18 aa, Escherichia coli
  misc feature (1)..(18): Escherichia coli O6 P0ADC2 RLPB ECOL6
MRYLATLLLSLAVLITAG

SEQ ID NO: 171 - protein, 18 aa, Escherichia coli
  misc feature (1)..(18): Escherichia coli P13810 E2AA ECOLX
MIKHVLLFFVFISFSVSA

SEQ ID NO: 172 - protein, 18 aa, Escherichia coli
  misc feature (1)..(18): Escherichia coli O9:H4 (strain HS) A7ZXR7 RLPB ECOHS
MRYLATLLLSLAVLITAG

SEQ ID NO: 173 - protein, 18 aa, Escherichia coli
  misc feature (1)..(18): Escherichia coli (strain K12) P24082 TRAN ECOLI
MKRILPLILALVAGMAQA

SEQ ID NO: 174 - protein, 18 aa, Escherichia coli
  misc feature (1)..(18): Escherichia coli (strain K12) P32167 YIIX ECOLI
MKNRLLILSLLVSVPAFA

SEQ ID NO: 175 - protein, 18 aa, Escherichia coli
  misc feature (1)..(18): Escherichia coli (strain K12) P77188 MATC ECOLI
MKKHLLPLALLFSGISPA

SEQ ID NO: 176 - protein, 18 aa, Escherichia coli
  misc feature (1)..(18): Escherichia coli O6 P0AF79 YJFJ ECOL6
MGILKSLFTLGKSFISQA

SEQ ID NO: 177 - protein, 18 aa, Escherichia coli
  misc feature (1)..(18): Escherichia coli O1:K1/APEC A1A8R6 RLPB ECOK1
MRYLATLLLSLAVLITAG

SEQ ID NO: 178 - protein, 18 aa, Escherichia coli
  misc feature (1)..(18): Escherichia coli (strain K12) P0ABM9 CCMH ECOLI
MRFLLGVLMLMISGSALA

SEQ ID NO: 179 - protein, 18 aa, Escherichia coli
  misc feature (1)..(18): Escherichia coli (strain K12) P76227 YNJH ECOLI
MSRALFAVVLAFPLIALA

SEQ ID NO: 180 - protein, 18 aa, Escherichia coli
  misc feature (1)..(18): Escherichia coli (strain K12) P75882 GFCD ECOLI
MKKNSYLLSCLAIAVSSA

SEQ ID NO: 181 - protein, 18 aa, Escherichia coli
  misc feature (1)..(18): Escherichia coli (strain ATCC 8739/DSM 1576/Crooks) B1IQS5 B1IQS5 ECOLC
MSKAGASLATCYGPVSAD

SEQ ID NO: 182 - protein, 18 aa, Escherichia coli
  misc feature (1)..(18): Escherichia coli (strain K12) P34749 HOFQ ECOLI
MKQWIAALLLMLIPGVQA

SEQ ID NO: 183 - protein, 18 aa, Escherichia coli
  misc feature (1)..(18): Escherichia coli O6:K15:H31 (strain 536/UPEC) Q0TK32 RLPB ECOL5
MRYLATLLLSLAVLITAG

SEQ ID NO: 184 - protein, 18 aa, Escherichia coli
  misc feature (1)..(18): Escherichia coli (strain K12) P76500 YFCQ ECOLI
MRKTFLTLLCVSSAIAHA

SEQ ID NO: 185 - protein, 18 aa, Escherichia coli
  misc feature (1)..(18): Escherichia coli Q46669 CDTB ECOLX
MKKYIISLIVFLSFYAQA

SEQ ID NO: 186 - protein, 18 aa, Escherichia coli
  misc feature (1)..(18): Escherichia coli (strain ATCC 8739/DSM 1576/Crooks) B1IU63 B1IU63 ECOLC
MRYFILMFTFVCSFVAAQ

SEQ ID NO: 187 - protein, 18 aa, Escherichia coli
  misc feature (1)..(18): Escherichia coli (strain K12) P0AFB1 NLPI ECOLI
MKPFLRWCFVATALTLAG

SEQ ID NO: 188 - protein, 18 aa, Escherichia coli
  misc feature (1)..(18): Escherichia coli P43530 ELAH ECOLX
MKNITFIFFILLASPLYA

SEQ ID NO: 189 - protein, 18 aa, Escherichia coli
  misc feature (1)..(18): Escherichia coli (strain K12) P0ADC1 RLPB ECOLI
MRYLATLLLSLAVLITAG

SEQ ID NO: 190 - protein, 19 aa, Escherichia coli
  misc feature (1)..(19): Escherichia coli Q47646 Q47646 ECOLX
MKKMIIAVLFGLFSANSMA

SEQ ID NO: 191 - protein, 19 aa, Escherichia coli
  misc feature (1)..(19): Escherichia coli (strain ATCC 8739/DSM 1576/Crooks) B1IUY5 B1IUY5 ECOLC
MSEALSLFSLFASSFLSAT

SEQ ID NO: 192 - protein, 19 aa, Escherichia coli
  misc feature (1)..(19): Escherichia coli (strain ATCC 8739/DSM 1576/Crooks) B1IPH0 B1IPH0 ECOLC
MSRALFAVVLAFPLIALAN

SEQ ID NO: 193 - protein, 19 aa, Escherichia coli
  misc feature (1)..(19): Escherichia coli (strain ATCC 8739/DSM 1576/Crooks) B1IY78 B1IY78 ECOLC
MRFLLGVLMLMISGSALAT

SEQ ID NO: 194 - protein, 19 aa, Escherichia coli
  misc feature (1)..(19): Escherichia coli (strain ATCC 8739/DSM 1576/Crooks) B1J0M9 B1J0M9 ECOLC
MIELLFPGWLAGIMLACAA

SEQ ID NO: 195 - protein, 19 aa, Escherichia coli
  misc feature (1)..(19): Escherichia coli O1:K1/APEC A1AJH6 NANM ECOK1
MNKTITALTIIMASFATNA

SEQ ID NO: 196 - protein, 19 aa, Escherichia coli
  misc feature (1)..(19): Escherichia coli (strain UTI89/UPEC) Q1R2K5 NANM ECOUT
MNKTITALTIIMASFATNA

SEQ ID NO: 197 - protein, 19 aa, Escherichia coli
  misc feature (1)..(19): Escherichia coli (strain K12) P36655 DSBD ECOLI
MAQRIFTLILLLCSTSVFA

SEQ ID NO: 198 - protein, 19 aa, Escherichia coli
  misc feature (1)..(19): Escherichia coli (strain K12) P32106 YIBG ECOLI
MKACLLLFFYFSFICQLHG

SEQ ID NO: 199 - protein, 19 aa, Escherichia coli
  misc feature (1)..(19): Escherichia coli (strain K12) P0AB46 YMGD ECOLI
MKKFALLAGLFVFAPMTWA

SEQ ID NO: 200 - protein, 19 aa, Escherichia coli
  misc feature (1)..(19): Escherichia coli P15176 LYS9 ECOLX
MKKITGIILLLLAAIILAA

SEQ ID NO: 201 - protein, 19 aa, Escherichia coli
  misc feature (1)..(19): Escherichia coli (strain K12) P0AA99 YAFK ECOLI
MRKIALILAMLLIPCVSFA

SEQ ID NO: 202 - protein, 19 aa, Escherichia coli
  misc feature (1)..(19): Escherichia coli (strain K12) P0AE98 CSGF ECOLI
MRVKHAVVLLMLISPLSWA

SEQ ID NO: 203 - protein, 19 aa, Escherichia coli
  misc feature (1)..(19): Escherichia coli O6 P0AC03 YFIO ECOL6
MTRMKYLVAAATLSLFLAG

SEQ ID NO: 204 - protein, 19 aa, Escherichia coli
  misc feature (1)..(19): Escherichia coli O157:H7 P0AB86 APBE ECO57
MEISFTRVALLAAALFFVG

SEQ ID NO: 205 - protein, 19 aa, Escherichia coli
  misc feature (1)..(19): Escherichia coli Q03709 LYS7 ECOLX
MKKITGIILLLLAAIILAA

SEQ ID NO: 206 - protein, 19 aa, Escherichia coli
  misc feature (1)..(19): Escherichia coli (strain K12) P65298 YQHH ECOLI
MKTIFTVGAVVLATCLLSG

SEQ ID NO: 207 - protein, 19 aa, Escherichia coli
  misc feature (1)..(19): Escherichia coli O157:H7 P0AEA0 CSGF ECO57
MRVKHAVVLLMLISPLSWA

SEQ ID NO: 208 - protein, 19 aa, Escherichia coli
  misc feature (1)..(19): Escherichia coli P13344 LYS5 ECOLX
MKKITWIILLLLAAIILAA

SEQ ID NO: 209 - protein, 19 aa, Escherichia coli
  misc feature (1)..(19): Escherichia coli O9:H4 (strain HS) A7ZZ38 FLGI ECOHS
MIKFLSALILLLVTTAAQA

SEQ ID NO: 210 - protein, 19 aa, Escherichia coli
  misc feature (1)..(19): Escherichia coli (strain ATCC 8739/DSM 1576/Crooks) B1J053 B1J053 ECOLC
MKKVILSLALGTFGLGMAE

SEQ ID NO: 211 - protein, 19 aa, Escherichia coli
  misc feature (1)..(19): Escherichia coli (strain K12) P77774 YFGL ECOLI
MQLRKLLLPGLLSVTLLSG

SEQ ID NO: 212 - protein, 19 aa, Escherichia coli
  misc feature (1)..(19): Escherichia coli P25402 FANE ECOLX
MNKFISIIALCVFSSYANA

SEQ ID NO: 213 - protein, 19 aa, Escherichia coli
  misc feature (1)..(19): Escherichia coli (strain ATCC 8739/DSM 1576/Crooks) B1IXB7 MEPA ECOLC
MNKTAIALLALLASSASLA

SEQ ID NO: 214 - protein, 19 aa, Escherichia coli
  misc feature (1)..(19): Escherichia coli (strain ATCC 8739/DSM 1576/Crooks) B1IRB0 B1IRB0 ECOLC
MLKKCLPLLLLCTAPVFAK

SEQ ID NO: 215 - protein, 19 aa, Escherichia coli
  misc feature (1)..(19): Escherichia coli (strain ATCC 8739/DSM 1576/Crooks) B1IUH6 B1IUH6 ECOLC
MNKGLLTLLLLFTCFARAQ

SEQ ID NO: 216 - protein, 19 aa, Escherichia coli
  misc feature (1)..(19): Escherichia coli (strain ATCC 8739/DSM 1576/Crooks) B1IY46 B1IY46 ECOLC
MKKLILIAMMASGLVACAQ

SEQ ID NO: 217 - protein, 19 aa, Escherichia coli
  misc feature (1)..(19): Escherichia coli (strain ATCC 8739/DSM 1576/Crooks) B1IPR5 B1IPR5 ECOLC
MKSTTYALIAVAAIAAFAL

SEQ ID NO: 218 - protein, 19 aa, Escherichia coli
  misc feature (1)..(19): Escherichia coli (strain UTI89/UPEC) Q1R3C4 DSBD ECOUT
MAQRIFTLILLLCSTSVFA

SEQ ID NO: 219 - protein, 19 aa, Escherichia coli
  misc feature (1)..(19): Escherichia coli (strain K12) P46122 YAJI ECOLI
MNTNVFRLLLLGSLFSLSA

SEQ ID NO: 220 - protein, 19 aa, Escherichia coli
  misc feature (1)..(19): Escherichia coli (strain K12) P0AEE1 DCRB ECOLI
MRNLVKYVGIGLLVMGLAA

SEQ ID NO: 221 - protein, 19 aa, Escherichia coli
  misc feature (1)..(19): Escherichia coli (strain K12) P0AC02 YFIO ECOLI
MTRMKYLVAAATLSLFLAG

SEQ ID NO: 222 - protein, 19 aa, Escherichia coli
  misc feature (1)..(19): Escherichia coli (strain ATCC 8739/DSM 1576/Crooks) B1IVA3 B1IVA3 ECOLC
MRVLLFLLLSLFMLPAFSA

SEQ ID NO: 223 - protein, 19 aa, Escherichia coli
  misc feature (1)..(19): Escherichia coli (strain K12) P76466 YFAT ECOLI
MRHGLLALICWLCCVVAHS

SEQ ID NO: 224 - protein, 19 aa, Escherichia coli
  misc feature (1)..(19): Escherichia coli (strain K12) P45766 YHDW ECOLI
MKKMMIATLAAASVLLAVA

SEQ ID NO: 225 - protein, 19 aa, Escherichia coli
  misc feature (1)..(19): Escherichia coli O1:K1/APEC A1ADH7 MEPA ECOK1
MNKTAIALLALLASSASLA

SEQ ID NO: 226 - protein, 19 aa, Escherichia coli
  misc feature (1)..(19): Escherichia coli O6 Q8CVG5 NANM2 ECOL6
MNKTITALAILMASFAANA

SEQ ID NO: 227 - protein, 19 aa, Escherichia coli
  misc feature (1)..(19): Escherichia coli (strain K12) P0ADN6 YIFL ECOLI
MKNVFKALTVLLTLFSLTG

SEQ ID NO: 228 - protein, 19 aa, Escherichia coli
  misc feature (1)..(19): Escherichia coli (strain K12) P58042 RZOR ECOLI
MRKLKMMLCVMMLPLVVVG

SEQ ID NO: 229 - protein, 19 aa, Escherichia coli
  misc feature (1)..(19): Escherichia coli (strain K12) P58041 RZOD ECOLI
MRKLKMMLCVMMLPLVVVG

SEQ ID NO: 230 - protein, 19 aa, Escherichia coli
  misc feature (1)..(19): Escherichia coli (strain UTI89/UPEC) Q1R984 MEPA ECOUT
MNKTAIALLALLASSASLA

SEQ ID NO: 231 - protein, 19 aa, Escherichia coli
  misc feature (1)..(19): Escherichia coli (strain ATCC 8739/DSM 1576/Crooks) B1IRF3 B1IRF3 ECOLC
MKWLLLITLSLYSFIVQSA

SEQ ID NO: 232 - protein, 19 aa, Escherichia coli
  misc feature (1)..(19): Escherichia coli O6 P0AB47 YMGD ECOL6
MKKFALLAGLFVFAPMTWA

SEQ ID NO: 233 - protein, 19 aa, Escherichia coli
  misc feature (1)..(19): Escherichia coli O157:H7 Q8XBJ0 YFEW ECO57
MKRTMLYLSLLAVSCSVSA

SEQ ID NO: 234 - protein, 19 aa, Escherichia coli
  misc feature (1)..(19): Escherichia coli (strain K12) P76462 YFAP ECOLI
MRKIFLPLLLVALSPVAHS

SEQ ID NO: 235 - protein, 19 aa, Escherichia coli
  misc feature (1)..(19): Escherichia coli (strain ATCC 8739/DSM 1576/Crooks) B1J0G3 B1J0G3 ECOLC
MSKPPLFFIVIIGLIVVAA

SEQ ID NO: 236 - protein, 19 aa, Escherichia coli
  misc feature (1)..(19): Escherichia coli O157:H7 P0AEG5 DSBA ECO57
MKKIWLALAGLVLAFSASA

SEQ ID NO: 237 - protein, 19 aa, Escherichia coli
  misc feature (1)..(19): Escherichia coli A2TJI4 CEXE ECOLX
MKKYILGVILAMGSLSAIA

SEQ ID NO: 238 - protein, 19 aa, Escherichia coli
  misc feature (1)..(19): Escherichia coli P01559 HST1 ECOLX
MKKLMLAIFISVLSFPSFS

SEQ ID NO: 239 - protein, 19 aa, Escherichia coli
  misc feature (1)..(19): Escherichia coli (strain K12) P23857 PSPE ECOLI
MFKKGLLALALVFSLPVFA

SEQ ID NO: 240 - protein, 19 aa, Escherichia coli
  misc feature (1)..(19): Escherichia coli Q7X2C2 Q7X2C2 ECOLX
MLRWKRCIILTFISGAAFA

SEQ ID NO: 241 - protein, 19 aa, Escherichia coli
  misc feature (1)..(19): Escherichia coli Q47191 Q47191 ECOLX
MIRLSLFISLLLTSVAVLA

SEQ ID NO: 242 - protein, 19 aa, Escherichia coli
  misc feature (1)..(19): Escherichia coli (strain K12) P28915 YBFC ECOLI
MKRVLFFLLMIFVSFGVIA

SEQ ID NO: 243 - protein, 19 aa, Escherichia coli
  misc feature (1)..(19): Escherichia coli P25732 CFAA ECOLX
MHKLFYLLSLLMAPFVANA

SEQ ID NO: 244 - protein, 19 aa, Escherichia coli
  misc feature (1)..(19): Escherichia coli (strain K12) P76177 YDGH ECOLI
MKLKNTLLASALLSAMAFS

SEQ ID NO: 245 - protein, 19 aa, Escherichia coli
  misc feature (1)..(19): Escherichia coli (strain ATCC 8739/DSM 1576/Crooks) B1IVE0 B1IVE0 ECOLC
MKNRLLILSLLVSVPAFAW

SEQ ID NO: 246 - protein, 19 aa, Escherichia coli
  misc feature (1)..(19): Escherichia coli O6 Q8CVV4 MEPA ECOL6
MNKTAIALLALLASSASLA

SEQ ID NO: 247 - protein, 19 aa, Escherichia coli
  misc feature (1)..(19): Escherichia coli Q47111 Q47111 ECOLX
MKKITGIILLLFAAIILAA

SEQ ID NO: 248 - protein, 19 aa, Escherichia coli
  misc feature (1)..(19): Escherichia coli P10099 LYS8 ECOLX
MKKITGIILLLLAVIILAA

SEQ ID NO: 249 - protein, 19 aa, Escherichia coli
  misc feature (1)..(19): Escherichia coli (strain ATCC 8739/DSM 1576/Crooks) B1IZR8 B1IZR8 ECOLC
MINILVACGSGVATSTLAA

SEQ ID NO: 250 - protein, 19 aa, Escherichia coli
  misc feature (1)..(19): Escherichia coli (strain ATCC 8739/DSM 1576/Crooks) B1J0L1 B1J0L1 ECOLC
MFKFLVLTLGIISCQAYAE

SEQ ID NO: 251 - protein, 19 aa, Escherichia coli
  misc feature (1)..(19): Escherichia coli O6 P0A938 SMPA ECOL6
MRCKTLTAAAAVLLMLTAG

SEQ ID NO: 252 - protein, 19 aa, Escherichia coli
  misc feature (1)..(19): Escherichia coli (strain K12) P37626 YHII ECOLI
MDKSKRHLAWWVVGLLAVA

SEQ ID NO: 253 - protein, 19 aa, Escherichia coli
  misc feature (1)..(19): Escherichia coli (strain K12) P30859 ARTI ECOLI
MKKVLIAALIAGFSLSATA

SEQ ID NO: 254 - protein, 19 aa, Escherichia coli
  misc feature (1)..(19): Escherichia coli O6 P65293 YGDI ECOL6
MKKTAAIISACMLTFALSA

SEQ ID NO: 255 - protein, 19 aa, Escherichia coli
  misc feature (1)..(19): Escherichia coli (strain ATCC 8739/DSM 1576/Crooks) B1IXB1 B1IXB1 ECOLC
MKKFLLLLLCAGCGAVLAA

SEQ ID NO: 256 - protein, 19 aa, Escherichia coli
  misc feature (1)..(19): Escherichia coli (strain ATCC 8739/DSM 1576/Crooks) B1IXG0 B1IXG0 ECOLC
MRWILFILFCLLGAPAHAV

SEQ ID NO: 257 - protein, 19 aa, Escherichia coli
  misc feature (1)..(19): Escherichia coli (strain K12) P14497 TRAF ECOLI
MNKALLPLLLCCFIFPASG

SEQ ID NO: 258 - protein, 19 aa, Escherichia coli
  misc feature (1)..(19): Escherichia coli O9:H4 (strain HS) A8A834 NANM ECOHS
MNKTITALAIMMASFAANA

SEQ ID NO: 259 - protein, 19 aa, Escherichia coli
  misc feature (1)..(19): Escherichia coli (strain K12) P77804 YDGA ECOLI
MNKSLVAVGVIVALGVVWT

SEQ ID NO: 260 - protein, 19 aa, Escherichia coli
  misc feature (1)..(19): Escherichia coli O157:H7 Q7BSX4 YFI3 ECO57
MRKYIPLVLFIFSWPVLCA

SEQ ID NO: 261 - protein, 19 aa, Escherichia coli
  misc feature (1)..(19): Escherichia coli (strain ATCC 8739/DSM 1576/Crooks) B1IYX1 B1IYX1 ECOLC
MKGLLSLLIFSMVLPAHAG

SEQ ID NO: 262 - protein, 19 aa, Escherichia coli
  misc feature (1)..(19): Escherichia coli P13812 E2AB ECOLX
MSSKKIIGAFVLMTGILSG

SEQ ID NO: 263 - protein, 19 aa, Escherichia coli
  misc feature (1)..(19): Escherichia coli O139:H28 (strain E24377A/ETEC) A7ZPE4 MEPA ECO24
MNKTAIALLALLASSASLA

SEQ ID NO: 264 - protein, 19 aa, Escherichia coli
  misc feature (1)..(19): Escherichia coli (strain K12) P30860 ARTJ ECOLI
MKKLVLAALLASFTFGASA

SEQ ID NO: 265 - protein, 19 aa, Escherichia coli
  misc feature (1)..(19): Escherichia coli (strain ATCC 8739/DSM 1576/Crooks) B1IQS7 B1IQS7 ECOLC
MLLATALLIVGLLLVVYSA

SEQ ID NO: 266 - protein, 19 aa, Escherichia coli
  misc feature (1)..(19): Escherichia coli O52986 O52986 ECOLX
MFFFRAILIVFFIGSDVQA

SEQ ID NO: 267 - protein, 19 aa, Escherichia coli
  misc feature (1)..(19): Escherichia coli (strain ATCC 8739/DSM 1576/Crooks) B1IP67 B1IP67 ECOLC
MSTIVIFLAALLACSLLAG

SEQ ID NO: 268 - protein, 19 aa, Escherichia coli
  misc feature (1)..(19): Escherichia coli O157:H7 P0AGD2 SODC ECO57
MKRFSLAILALVVATGAQA

SEQ ID NO: 269 - protein, 19 aa, Escherichia coli
  misc feature (1)..(19): Escherichia coli O6 P0ADN7 YIFL ECOL6
MKNVFKALTVLLTLFSLTG

SEQ ID NO: 270 - protein, 19 aa, Escherichia coli
  misc feature (1)..(19): Escherichia coli (strain K12) P76042 YCJN ECOLI
MIKSKIVLLSALVSCALIS

SEQ ID NO: 271 - protein, 19 aa, Escherichia coli
  misc feature (1)..(19): Escherichia coli (strain K12) P33913 YEJA ECOLI
MIVRILLLFIALFTFGVQA

SEQ ID NO: 272 - protein, 19 aa, Escherichia coli
  misc feature (1)..(19): Escherichia coli (strain K12) P0A6S3 FLGI ECOLI
MIKFLSALILLLVTTAAQA

SEQ ID NO: 273 - protein, 19 aa, Escherichia coli
  misc feature (1)..(19): Escherichia coli (strain K12) P0A937 SMPA ECOLI
MRCKTLTAAAAVLLMLTAG

SEQ ID NO: 274 - protein, 19 aa, Escherichia coli
  misc feature (1)..(19): Escherichia coli O6:K15:H31 (strain 536/UPEC) Q0T9Q5 DSBD ECOL5
MAQRIFTLILLLCSTSVFA

SEQ ID NO: 275 - protein, 19 aa, Escherichia coli
  misc feature (1)..(19): Escherichia coli O6:K15:H31 (strain 536/UPEC) Q0TIZ4 FLGI ECOL5
MIKFLSALILLLVITAAQA

SEQ ID NO: 276 - protein, 19 aa, Escherichia coli
  misc feature (1)..(19): Escherichia coli O139:H28 (strain E24377A/ETEC) A7ZKI5 FLGI ECO24
MIKFLSALILLLVTTAAQA

SEQ ID NO: 277 - protein, 19 aa, Escherichia coli
  misc feature (1)..(19): Escherichia coli (strain K12) P08331 CN16 ECOLI
MIKFSATLLATLIAASVNA

SEQ ID NO: 278 - protein, 19 aa, Escherichia coli
  misc feature (1)..(19): Escherichia coli (strain K12) P0AB85 APBE ECOLI
MEISFTRVALLAAALFFVG

SEQ ID NO: 279 - protein, 19 aa, Escherichia coli
  misc feature (1)..(19): Escherichia coli O6 P0AE99 CSGF ECOL6
MRVKHAVVLLMLISPLSWA

SEQ ID NO: 280 - protein, 19 aa, Escherichia coli
  misc feature (1)..(19): Escherichia coli P06963 LYS2 ECOLX
MKKITGIILLLLAVIILSA

SEQ ID NO: 281 - protein, 19 aa, Escherichia coli
  misc feature (1)..(19): Escherichia coli O157:H7 P58162 DSBD ECO57
MAQRIFTLILLLCSTSVFA

SEQ ID NO: 282 - protein, 19 aa, Escherichia coli
  misc feature (1)..(19): Escherichia coli P13345 LYS6 ECOLX
MKKITGIILLLLAVIILAA

SEQ ID NO: 283 - protein, 19 aa, Escherichia coli
  misc feature (1)..(19): Escherichia coli Q7X2B9 Q7X2B9 ECOLX
MSLTLNKILVLCALLISAM

SEQ ID NO: 284 - protein, 19 aa, Escherichia coli
  misc feature (1)..(19): Escherichia coli O157:H7 P0AAA0 YAFK ECO57
MRKIALILAMLLIPCVSFA

SEQ ID NO: 285 - protein, 19 aa, Escherichia coli
  misc feature (1)..(19): Escherichia coli (strain K12) P0AG78 SUBI ECOLI
MNKWGVGLTFLLAATSVMA

SEQ ID NO: 286 - protein, 19 aa, Escherichia coli
  misc feature (1)..(19): Escherichia coli Q57319 Q57319 ECOLX
MNKLFFLSFLCFLSYSAHA

SEQ ID NO: 287 - protein, 19 aa, Escherichia coli
  misc feature (1)..(19): Escherichia coli (strain ATCC 8739/DSM 1576/Crooks) B1ITP7 B1ITP7 ECOLC
MRLLPLVAAATAAFLVVAC

SEQ ID NO: 288 - protein, 19 aa, Escherichia coli
  misc feature (1)..(19): Escherichia coli O157:H7 Q8XCQ5 MEPA ECO57
MNKTAIALLALLASSVSLA

SEQ ID NO: 289 - protein, 19 aa, Escherichia coli
  misc feature (1)..(19): Escherichia coli O157:H7 P65296 YGDR ECO57
MKKWAVIISAVGLAFAVSG

SEQ ID NO: 290 - protein, 19 aa, Escherichia coli
  misc feature (1)..(19): Escherichia coli (strain K12) P65292 YGDI ECOLI
MKKTAAIISACMLTFALSA

SEQ ID NO: 291 - protein, 19 aa, Escherichia coli
  misc feature (1)..(19): Escherichia coli (strain K12) P65294 YGDR ECOLI
MKKWAVIISAVGLAFAVSG

SEQ ID NO: 292 - protein, 19 aa, Escherichia coli
  misc feature (1)..(19): Escherichia coli (strain K12) P31130 YDEI ECOLI
MKFQAIVLASFLVMPYALA

SEQ ID NO: 293 - protein, 19 aa, Escherichia coli
  misc feature (1)..(19): Escherichia coli O6:K15:H31 (strain 536/UPEC) Q0TFB8 MEPA ECOL5
MNKTAIALLALLASSASLA

SEQ ID NO: 294 - protein, 19 aa, Escherichia coli
  misc feature (1)..(19): Escherichia coli (strain K12) P39371 NANM ECOLI
MNKTITALAIMMASFAANA

SEQ ID NO: 295 - protein, 19 aa, Escherichia coli
  misc feature (1)..(19): Escherichia coli O127:H6 P0A4L6 DSBA ECO27
MKKIWLALAGLVLAFSASA

SEQ ID NO: 296 - protein, 19 aa, Escherichia coli
  misc feature (1)..(19): Escherichia coli O139:H28 (strain E24377A/ETEC) A7ZVK8 NANM ECO24
MNKTITALAIIMASFAANA

SEQ ID NO: 297 - protein, 19 aa, Escherichia coli
  misc feature (1)..(19): Escherichia coli (strain K12) P76463 YFAQ ECOLI
MNWRRIVWLLALVTLPTLA

SEQ ID NO: 298 - protein, 19 aa, Escherichia coli
  misc feature (1)..(19): Escherichia coli Q46946 Q46946 ECOLX
MFKKSILLFFISSSAIAGA

SEQ ID NO: 299 - protein, 19 aa, Escherichia coli
  misc feature (1)..(19): Escherichia coli (strain K12) P39285 YJEP ECOLI
MRLIITFLMAWCLSWGAYA

SEQ ID NO: 300 - protein, 19 aa, Escherichia coli
  misc feature (1)..(19): Escherichia coli (strain ATCC 8739/DSM 1576/Crooks) B1ISE2 B1ISE2 ECOLC
MKIILLFLAALASFTVHAQ

SEQ ID NO: 301 - protein, 19 aa, Escherichia coli
  misc feature (1)..(19): Escherichia coli O157:H7 P58203 FLGI ECO57
MIKFLSALILLLVTTAAQA

SEQ ID NO: 302 - protein, 19 aa, Escherichia coli
  misc feature (1)..(19): Escherichia coli (strain ATCC 8739/DSM 1576/Crooks) B1IQ25 B1IQ25 ECOLC
MKRLIPVALLTALLAGCAH

SEQ ID NO: 303 - protein, 19 aa, Escherichia coli
  misc feature (1)..(19): Escherichia coli P07965 HST3 ECOLX
MKKSILFIFLSVLSFSPFA

SEQ ID NO: 304 - protein, 19 aa, Escherichia coli
  misc feature (1)..(19): Escherichia coli O157:H7 Q8X554 NANM ECO57
MNKTITALAILMASFAANA

SEQ ID NO: 305 - protein, 19 aa, Escherichia coli
  misc feature (1)..(19): Escherichia coli O157:H7 P58068 YHDW ECO57
MKKMMIATLAAASVLLAVA

SEQ ID NO: 306 - protein, 19 aa, Escherichia coli
  misc feature (1)..(19): Escherichia coli (strain K12) P00811 AMPC ECOLI
MFKTTLCALLITASCSTFA

SEQ ID NO: 307 - protein, 19 aa, Escherichia coli
  misc feature (1)..(19): Escherichia coli Q47185 HST2 ECOLX
MKKSILFIFLSVLSFSPFA

SEQ ID NO: 308 - protein, 19 aa, Escherichia coli
  misc feature (1)..(19): Escherichia coli O6:K15:H31 (strain 536/UPEC) Q0T900 NANM ECOL5
MNKTITALTIIMASFATNA

SEQ ID NO: 309 - protein, 19 aa, Escherichia coli
  misc feature (1)..(19): Escherichia coli (strain ATCC 8739/DSM 1576/Crooks) B1IV39 B1IV39 ECOLC
MNKFLFAAALIVSGLLVGC

SEQ ID NO: 310 - protein, 19 aa, Escherichia coli
  misc feature (1)..(19): Escherichia coli O9:H4 (strain HS) A8A2J8 MEPA ECOHS
MNKTAIALLALLASSASLA

SEQ ID NO: 311 - protein, 19 aa, Escherichia coli
  misc feature (1)..(19): Escherichia coli (strain K12) P0AEG4 DSBA ECOLI
MKKIWLALAGLVLAFSASA

SEQ ID NO: 312 - protein, 19 aa, Escherichia coli
  misc feature (1)..(19): Escherichia coli (strain K12) Q47702 YFEK ECOLI
MKKIICLVITLLMTLPVYA

SEQ ID NO: 313 - protein, 19 aa, Escherichia coli
  misc feature (1)..(19): Escherichia coli O6 P65295 YGDR ECOL6
MKKWAVIISAVGLAFAVSG

SEQ ID NO: 314 - protein, 19 aa, Escherichia coli
  misc feature (1)..(19): Escherichia coli O157:H7 P0ADN8 YIFL ECO57
MKNVFKALTVLLTLFSLTG

SEQ ID NO: 315 - protein, 19 aa, Escherichia coli
  misc feature (1)..(19): Escherichia coli Q47644 Q47644 ECOLX
MKKMFIAVLFALVSVNAMA

SEQ ID NO: 316 - protein, 19 aa, Escherichia coli
  misc feature (1)..(19): Escherichia coli O6 Q8CVH5 DSBD ECOL6
MAQRIFTLILLLCSTSVFA

SEQ ID NO: 317 - protein, 19 aa, Escherichia coli
  misc feature (1)..(19): Escherichia coli O52987 O52987 ECOLX
MKKQPIVLTLGFFSFMVQA

SEQ ID NO: 318 - protein, 19 aa, Escherichia coli
  misc feature (1)..(19): Escherichia coli (strain K12) P39264 FIMI ECOLI
MKRKRLFLLASLLPMFALA

SEQ ID NO: 319 - protein, 19 aa, Escherichia coli
  misc feature (1)..(19): Escherichia coli (strain K12) P28722 YHCA ECOLI
MLRHITFTVFITTSMNTLA

SEQ ID NO: 320 - protein, 19 aa, Escherichia coli
  misc feature (1)..(19): Escherichia coli (strain K12) P0AGD1 SODC ECOLI
MKRFSLAILALVVATGAQA

SEQ ID NO: 321 - protein, 19 aa, Escherichia coli
  misc feature (1)..(19): Escherichia coli Q9ALL5 Q9ALL5 ECOLX
MKILYSFLLLPFFSCAFSV

SEQ ID NO: 322 - protein, 19 aa, Escherichia coli
  misc feature (1)..(19): Escherichia coli (strain K12) P76549 YFFR ECOLI
MKVLGNILWWAFVGFMAYA

SEQ ID NO: 323 - protein, 19 aa, Escherichia coli
  misc feature (1)..(19): Escherichia coli (strain K12) P0C0T5 MEPA ECOLI
MNKTAIALLALLASSASLA

SEQ ID NO: 324 - protein, 19 aa, Escherichia coli
  misc feature (1)..(19): Escherichia coli O6 P0A4L5 DSBA ECOL6
MKKIWLALAGLVLAFSASA

SEQ ID NO: 325 - protein, 19 aa, Escherichia coli
  misc feature (1)..(19): Escherichia coli (strain ATCC 8739/DSM 1576/Crooks) B1IVT5 B1IVT5 ECOLC
MKEKTIIIVGGGQAAAMAA

SEQ ID NO: 326 - protein, 19 aa, Escherichia coli
  misc feature (1)..(19): Escherichia coli (strain K12) P77619 YFEW ECOLI
MKRTMLYLSLLAVSCSVSA

SEQ ID NO: 327 - protein, 19 aa, Escherichia coli
  misc feature (1)..(19): Escherichia coli O157:H7 P0AC04 YFIO ECO57
MTRMKYLVAAATLSLFLAG

SEQ ID NO: 328 - protein, 19 aa, Escherichia coli
  misc feature (1)..(19): Escherichia coli (strain K12) P31666 YADE ECOLI
MYKQAVILLLMLFTASVSA

SEQ ID NO: 329 - protein, 20 aa, Escherichia coli
  misc feature (1)..(20): Escherichia coli (strain ATCC 8739/DSM 1576/Crooks) B1J083 B1J083 ECOLC
MIKRTLLAAAIFSALPAYAG

SEQ ID NO: 330 - protein, 20 aa, Escherichia coli
  misc feature (1)..(20): Escherichia coli Q1X7U7 Q1X7U7 ECOLX
MRLKYILIIPLLLISLSVFA

SEQ ID NO: 331 - protein, 20 aa, Escherichia coli
  misc feature (1)..(20): Escherichia coli (strain ATCC 8739/DSM 1576/Crooks) B1IXV9 B1IXV9 ECOLC
MRHGLLALICWLCCVVAHSE

SEQ ID NO: 332 - protein, 20 aa, Escherichia coli
  misc feature (1)..(20): Escherichia coli (strain ATCC 8739/DSM 1576/Crooks) B1IWF5 B1IWF5 ECOLC
MKKVFLCAILASLSYPAIAS

SEQ ID NO: 333 - protein, 20 aa, Escherichia coli
  misc feature (1)..(20): Escherichia coli Q1X7X6 Q1X7X6 ECOLX
MRLKYILIIPLLLISLSVFA

SEQ ID NO: 334 - protein, 20 aa, Escherichia coli
  misc feature (1)..(20): Escherichia coli Q9K598 Q9K598 ECOLX
MKKMFMAVLFALVSVNAMAA

SEQ ID NO: 335 - protein, 20 aa, Escherichia coli
  misc feature (1)..(20): Escherichia coli Q1X7V6 Q1X7V6 ECOLX
MRLKYILIIPLLLISLSVFA

SEQ ID NO: 336 - protein, 20 aa, Escherichia coli
  misc feature (1)..(20): Escherichia coli (strain ATCC 8739/DSM 1576/Crooks) B1IWR2 B1IWR2 ECOLC
MKKLVLAALLASFTFGASAA

SEQ ID NO: 337 - protein, 20 aa, Escherichia coli
  misc feature (1)..(20): Escherichia coli Q1X7W3 Q1X7W3 ECOLX
MRLKYILIIPLLLISLSVFA

SEQ ID NO: 338 - protein, 20 aa, Escherichia coli
  misc feature (1)..(20): Escherichia coli (strain UTI89/UPEC) Q1RGE4 SURA ECOUT
MKNWKTLLLGIAMIANTSFA

SEQ ID NO: 339 - protein, 20 aa, Escherichia coli
  misc feature (1)..(20): Escherichia coli (strain K12) O52982 YFJS ECOLI
MKRKTLPLLALVATSLFLSA

SEQ ID NO: 340 - protein, 20 aa, Escherichia coli
  misc feature (1)..(20): Escherichia coli P33783 FAEI ECOLX
MKKVTLFLFVVSLLPSTVLA

SEQ ID NO: 341 - protein, 20 aa, Escherichia coli
  misc feature (1)..(20): Escherichia coli Q1X7W2 Q1X7W2 ECOLX
MRLKYILIIPLLLISLSVFA

SEQ ID NO: 342 - protein, 20 aa, Escherichia coli
  misc feature (1)..(20): Escherichia coli O6 Q8CVL1 MDTE ECOL6
MNRRRKLLIPLLFCGAMLTA

SEQ ID NO: 343 - protein, 20 aa, Escherichia coli
  misc feature (1)..(20): Escherichia coli (strain K12) P06129 BTUB ECOLI
MIKKASLLTACSVTAFSAWA

SEQ ID NO: 344 - protein, 20 aa, Escherichia coli
  misc feature (1)..(20): Escherichia coli (strain K12) P38052 SFMF ECOLI
MRRVLFSCFCGLLWSSSGWA

SEQ ID NO: 345 - protein, 20 aa, Escherichia coli
  misc feature (1)..(20): Escherichia coli (strain ATCC 8739/DSM 1576/Crooks) B1IQL0 B1IQL0 ECOLC
MYKQAVILLLMLFTASVSAA

SEQ ID NO: 346 - protein, 20 aa, Escherichia coli
  misc feature (1)..(20): Escherichia coli O157:H7 P0ADB2 OSME ECO57
MNKNMAGILSAAAVLTMLAG

SEQ ID NO: 347 - protein, 20 aa, Escherichia coli
  misc feature (1)..(20): Escherichia coli O6:K15:H31 (strain 536/UPEC) Q0TA90 BTUB ECOL5
MIKKASLLTACSVTAFSAWA

SEQ ID NO: 348 - protein, 20 aa, Escherichia coli
  misc feature (1)..(20): Escherichia coli (strain ATCC 8739/DSM 1576/Crooks) B1J015 B1J015 ECOLC
MFKKILFPLVALFMLAGCAK

SEQ ID NO: 349 - protein, 20 aa, Escherichia coli
  misc feature (1)..(20): Escherichia coli O6 P0AA96 YACC ECOL6
MKTFFRTVLFGSLMAVCANS

SEQ ID NO: 350 - protein, 20 aa, Escherichia coli
  misc feature (1)..(20): Escherichia coli (strain ATCC 8739/DSM 1576/Crooks) B1ISY7 B1ISY7 ECOLC
MIKFSATLLATLIAASVNAA

SEQ ID NO: 351 - protein, 20 aa, Escherichia coli
  misc feature (1)..(20): Escherichia coli (strain K12) P39187 YTFJ ECOLI
MTLRKILALTCLLLPMMASA

SEQ ID NO: 352 - protein, 20 aa, Escherichia coli
  misc feature (1)..(20): Escherichia coli O157:H7 P0AF88 YJFY ECO57
MFSRVLALLAVLLLSANTWA

SEQ ID NO: 353 - protein, 20 aa, Escherichia coli
  misc feature (1)..(20): Escherichia coli (strain K12) P64506 YEBY ECOLI
MMKKSILAFLLLTSSAAALA

SEQ ID NO: 354 - protein, 20 aa, Escherichia coli
  misc feature (1)..(20): Escherichia coli (strain ATCC 8739/DSM 1576/Crooks) B1IZF1 B1IZF1 ECOLC
MRIKLLAITGIVILQPVWAE

SEQ ID NO: 355 - protein, 20 aa, Escherichia coli
  misc feature (1)..(20): Escherichia coli O9:H4 (strain HS) A8A774 BTUB ECOHS
MIKKASLLTACSVTAFSAWA

SEQ ID NO: 356 - protein, 20 aa, Escherichia coli
  misc feature (1)..(20): Escherichia coli O157:H7 P0A936 MLTA ECO57
MKGRWVKYLLMGTVVAMLAA

SEQ ID NO: 357 - protein, 20 aa, Escherichia coli
  misc feature (1)..(20): Escherichia coli O157:H7 Q8XAR3 PGAB ECO57
MLRNGNKYLLMLVSIIMLTA

SEQ ID NO: 358 - protein, 20 aa, Escherichia coli
  misc feature (1)..(20): Escherichia coli P35695 BLO7 ECOLX
MKTFAAYVITACLSSTALAS

SEQ ID NO: 359 - protein, 20 aa, Escherichia coli
  misc feature (1)..(20): Escherichia coli (strain K12) P0A932 GFCE ECOLI
MKKNIFKFSVLTLAVLSLTA

SEQ ID NO: 360 - protein, 20 aa, Escherichia coli
  misc feature (1)..(20): Escherichia coli O6 P0AFM5 PSIF ECOL6
MKITLLVTLLFGLVFLTTVG

SEQ ID NO: 361 - protein, 20 aa, Escherichia coli
  misc feature (1)..(20): Escherichia coli O139:H28 (strain E24377A/ETEC) A7ZP31 ECOT ECO24
MKTILPAVLFAAFATTSAWA

SEQ ID NO: 362 - protein, 20 aa, Escherichia coli
  misc feature (1)..(20): Escherichia coli Q1X7U9 Q1X7U9 ECOLX
MRLKYILIIPLLLISLSVFA

SEQ ID NO: 363 - protein, 20 aa, Escherichia coli
  misc feature (1)..(20): Escherichia coli (strain K12) P0A930 WZA ECOLI
MMKSKMKLMPLLVSVTLISG

SEQ ID NO: 364 - protein, 20 aa, Escherichia coli
  misc feature (1)..(20): Escherichia coli Q1X7V5 Q1X7V5 ECOLX
MRLKYILIIPLLLISLSVFA

SEQ ID NO: 365 - protein, 20 aa, Escherichia coli
  misc feature (1)..(20): Escherichia coli O6:K15:H31 (strain 536/UPEC) Q0TLF6 YAET ECOL5
MAMKKLLIASLLFSSATVYG

SEQ ID NO: 366 - protein, 20 aa, Escherichia coli
  misc feature (1)..(20): Escherichia coli (strain K12) P0AFM4 PSIF ECOLI
MKITLLVTLLFGLVFLTTVG

SEQ ID NO: 367 - protein, 20 aa, Escherichia coli
  misc feature (1)..(20): Escherichia coli (strain ATCC 8739/DSM 1576/Crooks) B1IQD9 B1IQD9 ECOLC
MNKSLVAVGVIVALGVVWTG

SEQ ID NO: 368 - protein, 20 aa, Escherichia coli
  misc feature (1)..(20): Escherichia coli (strain ATCC 8739/DSM 1576/Crooks) B1IRS4 B1IRS4 ECOLC
MKFQAIVLASFLVMPYALAD

SEQ ID NO: 369 - protein, 20 aa, Escherichia coli
  misc feature (1)..(20): Escherichia coli (strain ATCC 8739/DSM 1576/Crooks) B1IXW2 B1IXW2 ECOLC
MRKIFLPLLLVALSPVAHSE

SEQ ID NO: 370 - protein, 20 aa, Escherichia coli
  misc feature (1)..(20): Escherichia coli O32579 O32579 ECOLX
MMKKSLCCALLLTASFSTFA

SEQ ID NO: 371 - protein, 20 aa, Escherichia coli
  misc feature (1)..(20): Escherichia coli (strain ATCC 8739/DSM 1576/Crooks) B1IPR7 B1IPR7 ECOLC
MKKVVLMALALGLSLPAMAS

SEQ ID NO: 372 - protein, 20 aa, Escherichia coli
  misc feature (1)..(20): Escherichia coli (strain ATCC 8739/DSM 1576/Crooks) B1IY92 B1IY92 ECOLC
MIVRILLLFIALFTFGAQAQ

SEQ ID NO: 373 - protein, 20 aa, Escherichia coli
  misc feature (1)..(20): Escherichia coli O6:K15:H31 (strain 536/UPEC) Q0TJ96 YCCT ECOL5
MKTGIVTTLIALCLPVSVFA

SEQ ID NO: 374 - protein, 20 aa, Escherichia coli
  misc feature (1)..(20): Escherichia coli (strain UTI89/UPEC) Q1RD77 FLGI ECOUT
MVIKFLSALILLLVTTAAQA

SEQ ID NO: 375 - protein, 20 aa, Escherichia coli
  misc feature (1)..(20): Escherichia coli (strain ATCC 8739/DSM 1576/Crooks) B1IVW8 YCCT ECOLC
MKTGIVTTLIALCLPVSVFA

SEQ ID NO: 376 - protein, 20 aa, Escherichia coli
  misc feature (1)..(20): Escherichia coli (strain K12) P0ADU5 YGIW ECOLI
MKKFAAVIAVMALCSAPVMA

SEQ ID NO: 377 - protein, 20 aa, Escherichia coli
  misc feature (1)..(20): Escherichia coli P43528 E2BA ECOLX
MAKVISFFISLFLISFPLYA

SEQ ID NO: 378 - protein, 20 aa, Escherichia coli
  misc feature (1)..(20): Escherichia coli (strain K12) P45422 YHCF ECOLI
MNNVKLLIAGSAFFAMSAQA

SEQ ID NO: 379 - protein, 20 aa, Escherichia coli
  misc feature (1)..(20): Escherichia coli (strain K12) P76655 YQIG ECOLI
MSGNIGANPVIIIGCASAYA

SEQ ID NO: 380 - protein, 20 aa, Escherichia coli
  misc feature (1)..(20): Escherichia coli (strain K12) P0ADB1 OSME ECOLI
MNKNMAGILSAAAVLTMLAG

SEQ ID NO: 381 - protein, 20 aa, Escherichia coli
  misc feature (1)..(20): Escherichia coli P15177 TRAT4 ECOLX
MKTKKLMMVALVSSTLALSG

SEQ ID NO: 382 - protein, 20 aa, Escherichia coli
  misc feature (1)..(20): Escherichia coli O6 P0ABZ7 SURA ECOL6
MKNWKTLLLGIAMIANTSFA

SEQ ID NO: 383 - protein, 20 aa, Escherichia coli
  misc feature (1)..(20): Escherichia coli (strain K12) P75749 YBGP ECOLI
MTFIKGLPLMLLTISLGCNA

SEQ ID NO: 384 - protein, 20 aa, Escherichia coli
  misc feature (1)..(20): Escherichia coli O157:H7 P64452 YDCL ECO57
MRTTSFAKVAALCGLLALSG

SEQ ID NO: 385 - protein, 20 aa, Escherichia coli
  misc feature (1)..(20): Escherichia coli O157:H7 Q8X4L0 MDTE ECO57
MNRRRKLLIPLLFCGAMLTA

SEQ ID NO: 386 - protein, 20 aa, Escherichia coli
  misc feature (1)..(20): Escherichia coli O6 Q8CVW3 ECOT ECOL6
MKTILPAVLFAAFATTSAWA

SEQ ID NO: 387 - protein, 20 aa, Escherichia coli
  misc feature (1)..(20): Escherichia coli (strain K12) P75804 YLII ECOLI
MHRQSFFLVPLICLSSALWA

SEQ ID NO: 388 - protein, 20 aa, Escherichia coli
  misc feature (1)..(20): Escherichia coli O9:H4 (strain HS) A8A271 ECOT ECOHS
MKTILPAVLFAAFATTSAWA

SEQ ID NO: 389 - protein, 20 aa, Escherichia coli
  misc feature (1)..(20): Escherichia coli Q1X7X3 Q1X7X3 ECOLX
MRLKYILIIPLLLISLSVFA

SEQ ID NO: 390 - protein, 20 aa, Escherichia coli
  misc feature (1)..(20): Escherichia coli Q9ALK8 Q9ALK8 ECOLX
MLRIFITILLLLTSLVTKAE

SEQ ID NO: 391 - protein, 20 aa, Escherichia coli
  misc feature (1)..(20): Escherichia coli O6 P0AAX0 YBHT ECOL6
MLELLKSLVFAVIMVPVVMA

SEQ ID NO: 392 - protein, 20 aa, Escherichia coli
  misc feature (1)..(20): Escherichia coli (strain ATCC 8739/DSM 1576/Crooks) B1IT44 B1IT44 ECOLC
MRLIITFLMAWCLSWGAYAA

SEQ ID NO: 393 - protein, 20 aa, Escherichia coli
  misc feature (1)..(20): Escherichia coli (strain ATCC 8739/DSM 1576/Crooks) B1ITE5 B1ITE5 ECOLC
MFKKGLLALALVFSLPVFAA

SEQ ID NO: 394 - protein, 20 aa, Escherichia coli
  misc feature (1)..(20): Escherichia coli Q47459 PCOE ECOLX
MKKILVSFVAIMAVASSAMA

SEQ ID NO: 395 - protein, 20 aa, Escherichia coli
  misc feature (1)..(20): Escherichia coli Q93SE0 BTUB ECOLX
MIKKYWFLMVYSVTAFSVWA

SEQ ID NO: 396 - protein, 20 aa, Escherichia coli
  misc feature (1)..(20): Escherichia coli Q06BL1 Q06BL1 ECOLX
MRLKYILIIPLLLISLSVFA

SEQ ID NO: 397 - protein, 20 aa, Escherichia coli
  misc feature (1)..(20): Escherichia coli O157:H7 Q8X714 BTUB ECO57
MIKKASLLTACSVTAFSAWA

SEQ ID NO: 398 - protein, 20 aa, Escherichia coli
  misc feature (1)..(20): Escherichia coli (strain K12) P37636 MDTE ECOLI
MNRRRKLLIPLLFCGAMLTA

SEQ ID NO: 399 - protein, 20 aa, Escherichia coli
  misc feature (1)..(20): Escherichia coli O6 P69777 LPP ECOL6
MKATKLVLGAVILGSTLLAG

SEQ ID NO: 400 - protein, 20 aa, Escherichia coli
  misc feature (1)..(20): Escherichia coli O157:H7 P0ABZ8 SURA ECO57
MKNWKTLLLGIAMIANTSFA

SEQ ID NO: 401 - protein, 20 aa, Escherichia coli
  misc feature (1)..(20): Escherichia coli (strain K12) P37665 YIAD ECOLI
MKKRVYLIAAVVSGALAVSG

SEQ ID NO: 402 - protein, 20 aa, Escherichia coli
  misc feature (1)..(20): Escherichia coli Q4JH75 Q4JH75 ECOLX
MRNKPFYLLCAFLWLAVSHA

SEQ ID NO: 403 - protein, 20 aa, Escherichia coli
  misc feature (1)..(20): Escherichia coli (strain K12) P0A8X4 YCCT ECOLI
MKTGIVTTLIALCLPVSVFA

SEQ ID NO: 404 - protein, 20 aa, Escherichia coli
  misc feature (1)..(20): Escherichia coli (strain K12) P76773 OMPL ECOLI
MKKINAIILLSSLTSASVFA

SEQ ID NO: 405 - protein, 20 aa, Escherichia coli
  misc feature (1)..(20): Escherichia coli O6 P0A8X5 YCCT ECOL6
MKTGIVTTLIALCLPVSVFA

SEQ ID NO: 406 - protein, 20 aa, Escherichia coli
  misc feature (1)..(20): Escherichia coli O157:H7 P0AEG7 DSBC ECO57
MKKGFMLFTLLAAFSGFAQA

SEQ ID NO: 407 - protein, 20 aa, Escherichia coli
  misc feature (1)..(20): Escherichia coli O157:H7 P0AAX1 YBHT ECO57
MLELLKSLVFAVIMVPVVMA

SEQ ID NO: 408 - protein, 20 aa, Escherichia coli
  misc feature (1)..(20): Escherichia coli (strain K12) P0A921 PA1 ECOLI
MRTLQGWLLPVFMLPMAVYA

SEQ ID NO: 409 - protein, 20 aa, Escherichia coli
  misc feature (1)..(20): Escherichia coli (strain K12) P0ACW4 YDCA ECOLI
MKKLALILFMGTLVSFYADA

SEQ ID NO: 410 - protein, 20 aa, Escherichia coli
  misc feature (1)..(20): Escherichia coli O6 Q8CVJ0 BTUB ECOL6
MIKKASLLTACSVTAFSAWA

SEQ ID NO: 411 - protein, 20 aa, Escherichia coli
  misc feature (1)..(20): Escherichia coli (strain K12) P0A940 YAET ECOLI
MAMKKLLIASLLFSSATVYG

SEQ ID NO: 412 - protein, 20 aa, Escherichia coli
  misc feature (1)..(20): Escherichia coli O157:H7 P0A942 YAET ECO57
MAMKKLLIASLLFSSATVYG

SEQ ID NO: 413 - protein, 20 aa, Escherichia coli
  misc feature (1)..(20): Escherichia coli Q9ALK7 Q9ALK7 ECOLX
MLKRISCIIFVFFSGLIYAA

SEQ ID NO: 414 - protein, 20 aa, Escherichia coli
  misc feature (1)..(20): Escherichia coli (strain ATCC 8739/DSM 1576/Crooks) B1IQE4 B1IQE4 ECOLC
MRALPICLVALMLSGCSMLS

SEQ ID NO: 415 - protein, 20 aa, Escherichia coli
  misc feature (1)..(20): Escherichia coli O157:H7 Q8XE46 ECOT ECO57
MKTILPAVLFAAFATTSAWA

SEQ ID NO: 416 - protein, 20 aa, Escherichia coli
  misc feature (1)..(20): Escherichia coli (strain K12) P42616 YQJC ECOLI
MKYRIALAVSLFALSAGSYA

SEQ ID NO: 417 - protein, 20 aa, Escherichia coli
  misc feature (1)..(20): Escherichia coli Q1X7V0 Q1X7V0 ECOLX
MRLKYILIIPLLLISLSVFA

SEQ ID NO: 418 - protein, 20 aa, Escherichia coli
  misc feature (1)..(20): Escherichia coli (strain ATCC 8739/DSM 1576/Crooks) B1IVY0 B1IVY0 ECOLC
MKKWLVTIAALWLAGCSSGE

SEQ ID NO: 419 - protein, 20 aa, Escherichia coli
  misc feature (1)..(20): Escherichia coli (strain K12) P23827 ECOT ECOLI
MKTILPAVLFAAFATTSAWA

SEQ ID NO: 420 - protein, 20 aa, Escherichia coli
  misc feature (1)..(20): Escherichia coli (strain K12) P69776 LPP ECOLI
MKATKLVLGAVILGSTLLAG

SEQ ID NO: 421 - protein, 20 aa, Escherichia coli
  misc feature (1)..(20): Escherichia coli O157:H7 P0A8X6 YCCT ECO57
MKTGIVTTLIALCLPVSVFA

SEQ ID NO: 422 - protein, 20 aa, Escherichia coli
  misc feature (1)..(20): Escherichia coli (strain K12) P43319 YRAK ECOLI
MKRAPLITGLLLISTSCAYA

SEQ ID NO: 423 - protein, 20 aa, Escherichia coli
  misc feature (1)..(20): Escherichia coli P53519 CSSC2 ECOLX
MKSKLIILLTLVPFSSFSTG

SEQ ID NO: 424 - protein, 20 aa, Escherichia coli
  misc feature (1)..(20): Escherichia coli (strain UTI89/UPEC) Q1RDP9 YCCT ECOUT
MKTGIVTTLIALCLPVSVFA

SEQ ID NO: 425 - protein, 20 aa, Escherichia coli
  misc feature (1)..(20): Escherichia coli (strain ATCC 8739/DSM 1576/Crooks) B1IWQ9 B1IWQ9 ECOLC
MKKVLIAALIAGFSLSATAA

SEQ ID NO: 426 - protein, 20 aa, Escherichia coli
  misc feature (1)..(20): Escherichia coli Q1X7U6 Q1X7U6 ECOLX
MRLKYILIIPLLLISLSVFA

SEQ ID NO: 427 - protein, 20 aa, Escherichia coli
  misc feature (1)..(20): Escherichia coli (strain ATCC 8739/DSM 1576/Crooks) B1IXW1 B1IXW1 ECOLC
MNWRRIVWLLALVTLPTLAE

SEQ ID NO: 428 - protein, 20 aa, Escherichia coli
  misc feature (1)..(20): Escherichia coli (strain ATCC 8739/DSM 1576/Crooks) B1IQJ9 B1IQJ9 ECOLC
MKKTLLAAALVMVSGSALAV

SEQ ID NO: 429 - protein, 20 aa, Escherichia coli
  misc feature (1)..(20): Escherichia coli O32580 O32580 ECOLX
MMKKSLCCALLLTASFSTFA

SEQ ID NO: 430 - protein, 20 aa, Escherichia coli
  misc feature (1)..(20): Escherichia coli Q1X7W9 Q1X7W9 ECOLX
MRLKYILIIPLLLISLSVFA

SEQ ID NO: 431 - protein, 20 aa, Escherichia coli
  misc feature (1)..(20): Escherichia coli O157:H7 P0AEU9 SKP ECO57
MKKWLLAAGLGLALATSAQA

SEQ ID NO: 432 - protein, 20 aa, Escherichia coli
  misc feature (1)..(20): Escherichia coli O52985 O52985 ECOLX
MKIKKFKLVFYMVIFYVISL

SEQ ID NO: 433 - protein, 20 aa, Escherichia coli
  misc feature (1)..(20): Escherichia coli O9:H4 (strain HS) A7ZWC3 YAET ECOHS
MAMKKLLIASLLFSSATVYG

SEQ ID NO: 434 - protein, 20 aa, Escherichia coli
  misc feature (1)..(20): Escherichia coli O139:H28 (strain E24377A/ETEC) A7ZHR7 YAET ECO24
MAMKKLLIASLLFSSATVYG

SEQ ID NO: 435 - protein, 20 aa, Escherichia coli
  misc feature (1)..(20): Escherichia coli (strain ATCC 8739/DSM 1576/Crooks) B1ISA4 B1ISA4 ECOLC
MKRVITLFAVLLMGWSVNAW

SEQ ID NO: 436 - protein, 20 aa, Escherichia coli
  misc feature (1)..(20): Escherichia coli (strain K12) P08189 FIMF ECOLI
MRNKPFYLLCAFLWLAVSHA

SEQ ID NO: 437 - protein, 20 aa, Escherichia coli
  misc feature (1)..(20): Escherichia coli (strain K12) P0AAW9 YBHT ECOLI
MLELLKSLVFAVIMVPVVMA

SEQ ID NO: 438 - protein, 20 aa, Escherichia coli
  misc feature (1)..(20): Escherichia coli (strain ATCC 8739/DSM 1576/Crooks) B1IY25 B1IY25 ECOLC
MKRVLFFLLMIFVSFGVIAD

SEQ ID NO: 439 - protein, 20 aa, Escherichia coli
  misc feature (1)..(20): Escherichia coli O6 P0A941 YAET ECOL6
MAMKKLLIASLLFSSATVYG

SEQ ID NO: 440 - protein, 20 aa, Escherichia coli
  misc feature (1)..(20): Escherichia coli (strain ATCC 8739/DSM 1576/Crooks) B1IW52 B1IW52 ECOLC
MKKIWLALAGLVLAFSASAA

SEQ ID NO: 441 - protein, 20 aa, Escherichia coli
  misc feature (1)..(20): Escherichia coli (strain UTI89/UPEC) Q1RG12 YAET ECOUT
MAMKKLLIASLLFSSATVYG

SEQ ID NO: 442 - protein, 20 aa, Escherichia coli
  misc feature (1)..(20): Escherichia coli O139:H28 (strain E24377A/ETEC) A7ZUI6 BTUB ECO24
MIKKASLLTACSVTAFSAWA

SEQ ID NO: 443 - protein, 20 aa, Escherichia coli
  misc feature (1)..(20): Escherichia coli O9:H4 (strain HS) A7ZYR6 YCCT ECOHS
MKTGIVTTLIALCLPVSVFA

SEQ ID NO: 444 - protein, 20 aa, Escherichia coli
  misc feature (1)..(20): Escherichia coli (strain K12) P24228 DACB ECOLI
MRFSRFIIGLTSCIAFSVQA

SEQ ID NO: 445 - protein, 20 aa, Escherichia coli
  misc feature (1)..(20): Escherichia coli (strain K12) P33340 YEHA ECOLI
MEIRIMLFILMMMVMPVSYA

SEQ ID NO: 446 - protein, 20 aa, Escherichia coli
  misc feature (1)..(20): Escherichia coli Q1X7X9 Q1X7X9 ECOLX
MRLKYILIIPLLLISLSVFA

SEQ ID NO: 447 - protein, 20 aa, Escherichia coli
  misc feature (1)..(20): Escherichia coli (strain ATCC 8739/DSM 1576/Crooks) B1J0P9 B1J0P9 ECOLC
MKKSILAFLLLTSSAAALAA

SEQ ID NO: 448 - protein, 20 aa, Escherichia coli
  misc feature (1)..(20): Escherichia coli O1:K1/APEC A1AIE8 BTUB ECOK1
MIKKASLLTACSVTAFSAWA

SEQ ID NO: 449 - protein, 20 aa, Escherichia coli
  misc feature (1)..(20): Escherichia coli O157:H7 P0A933 GFCE ECO57
MKKNIFKFSVLTLAVLSLTA

SEQ ID NO: 450 - protein, 20 aa, Escherichia coli
  misc feature (1)..(20): Escherichia coli (strain ATCC 8739/DSM 1576/Crooks) B1IQG4 YAET ECOLC
MAMKKLLIASLLFSSATVYG

SEQ ID NO: 451 - protein, 20 aa, Escherichia coli
  misc feature (1)..(20): Escherichia coli (strain ATCC 8739/DSM 1576/Crooks) B1IVG2 B1IVG2 ECOLC
MNKWGVGLTFLLAATSVMAK

SEQ ID NO: 452 - protein, 20 aa, Escherichia coli
  misc feature (1)..(20): Escherichia coli (strain K12) P40710 NLPE ECOLI
MVKKAIVTAMAVISLFTLMG

SEQ ID NO: 453 - protein, 20 aa, Escherichia coli
  misc feature (1)..(20): Escherichia coli O157:H7 P58603 OMPT ECO57
MRAKLLGIVLTTPIAISSFA

SEQ ID NO: 454 - protein, 20 aa, Escherichia coli
  misc feature (1)..(20): Escherichia coli (strain ATCC 8739/DSM 1576/Crooks) B1ITR2 B1ITR2 ECOLC
MAQRIFTLILLLCSTSVFAG

SEQ ID NO: 455 - protein, 20 aa, Escherichia coli
  misc feature (1)..(20): Escherichia coli O1:K1/APEC A1A9X5 FLGI ECOK1
MVIKFLSALILLLVTTAAQA

SEQ ID NO: 456 - protein, 20 aa, Escherichia coli
  misc feature (1)..(20): Escherichia coli Q1X7U8 Q1X7U8 ECOLX
MRLKYILIIPLLLISLSVFA

SEQ ID NO: 457 - protein, 20 aa, Escherichia coli
  misc feature (1)..(20): Escherichia coli (strain K12) P0AEU7 SKP ECOLI
MKKWLLAAGLGLALATSAQA

SEQ ID NO: 458 - protein, 20 aa, Escherichia coli
  misc feature (1)..(20): Escherichia coli (strain K12) P09169 OMPT ECOLI
MRAKLLGIVLTTPIAISSFA

SEQ ID NO: 459 - protein, 20 aa, Escherichia coli
  misc feature (1)..(20): Escherichia coli (strain ATCC 8739/DSM 1576/Crooks) B1IZR3 B1IZR3 ECOLC
MKKILVVCGNGIASSSIMVS

SEQ ID NO: 460 - protein, 20 aa, Escherichia coli
  misc feature (1)..(20): Escherichia coli Q03961 KPSD1 ECOLX
MKLFKSILLIAACHAAQASA

SEQ ID NO: 461 - protein, 20 aa, Escherichia coli
  misc feature (1)..(20): Escherichia coli (strain ATCC 8739/DSM 1576/Crooks) B1J0K2 B1J0K2 ECOLC
MINRIRVVTLLVMVLGVFAL

SEQ ID NO: 462 - protein, 20 aa, Escherichia coli
  misc feature (1)..(20): Escherichia coli (strain ATCC 8739/DSM 1576/Crooks) B1IUC0 B1IUC0 ECOLC
MKKFALLAGLFVFAPMTWAQ

SEQ ID NO: 463 - protein, 20 aa, Escherichia coli
  misc feature (1)..(20): Escherichia coli Q1X7W0 Q1X7W0 ECOLX
MRLKYILIIPLLLISLSVFA

SEQ ID NO: 464 - protein, 20 aa, Escherichia coli
  misc feature (1)..(20): Escherichia coli (strain ATCC 8739/DSM 1576/Crooks) B1IX42 B1IX42 ECOLC
MKRTMLYLSLLAVSCSVSAA

SEQ ID NO: 465 - protein, 20 aa, Escherichia coli
  misc feature (1)..(20): Escherichia coli P53518 CSSC1 ECOLX
MKSKLIILLMLVPFSSFSTE

SEQ ID NO: 466 - protein, 20 aa, Escherichia coli
  misc feature (1)..(20): Escherichia coli O6 P0AF87 YJFY ECOL6
MFSRVLALLAVLLLSANTWA

SEQ ID NO: 467 - protein, 20 aa, Escherichia coli
  misc feature (1)..(20): Escherichia coli (strain K12) P77365 YAFY ECOLI
MKRKTLPLLALVATTLFLIA

SEQ ID NO: 468 - protein, 20 aa, Escherichia coli
  misc feature (1)..(20): Escherichia coli O157:H7 P0A922 PA1 ECO57
MRTLQGWLLPVFMLPMAVYA

SEQ ID NO: 469 - protein, 20 aa, Escherichia coli
  misc feature (1)..(20): Escherichia coli Q1X7X2 Q1X7X2 ECOLX
MRLKYILIIPLLLISLSVFA

SEQ ID NO: 470 - protein, 20 aa, Escherichia coli
  misc feature (1)..(20): Escherichia coli (strain K12) P32688 YJBG ECOLI
MIKQTIVALLLSVGASSVFA

SEQ ID NO: 471 - protein, 20 aa, Escherichia coli
  misc feature (1)..(20): Escherichia coli (strain ATCC 8739/DSM 1576/Crooks) B1IRW3 B1IRW3 ECOLC
MKRVLIPGVILCGADVAQAV

SEQ ID NO: 472 - protein, 20 aa, Escherichia coli
  misc feature (1)..(20): Escherichia coli O1:K1/APEC A1A9N3 YCCT ECOK1
MKTGIVTTLIALCLPVSVFA

SEQ ID NO: 473 - protein, 20 aa, Escherichia coli
  misc feature (1)..(20): Escherichia coli (strain K12) P76104 YDCP ECOLI
MTVSSHRLELLSPARDAAIA

SEQ ID NO: 474 - protein, 20 aa, Escherichia coli
  misc feature (1)..(20): Escherichia coli Q1X7V9 Q1X7V9 ECOLX
MRLKYILIIPLLLISLSVFA

SEQ ID NO: 475 - protein, 20 aa, Escherichia coli
  misc feature (1)..(20): Escherichia coli (strain K12) P28307 CSGA ECOLI
MKLLKVAAIAAIVFSGSALA

SEQ ID NO: 476 - protein, 20 aa, Escherichia coli
  misc feature (1)..(20): Escherichia coli O157:H7 P0ADU6 YGIW ECO57
MKKFAAVIAVMALCSAPVMA

SEQ ID NO: 477 - protein, 20 aa, Escherichia coli
  misc feature (1)..(20): Escherichia coli O157:H7 Q93U24 CSGA ECO57
MKLLKVAAIAAIVFSGSALA

SEQ ID NO: 478 - protein, 20 aa, Escherichia coli
  misc feature (1)..(20): Escherichia coli (strain K12) P0AA95 YACC ECOLI
MKTFFRTVLFGSLMAVCANS

SEQ ID NO: 479 - protein, 20 aa, Escherichia coli
  misc feature (1)..(20): Escherichia coli (strain ATCC 8739/DSM 1576/Crooks) B1IRM2 B1IRM2 ECOLC
MDKKLLALLILASLSPAEAA

SEQ ID NO: 480 - protein, 20 aa, Escherichia coli
  misc feature (1)..(20): Escherichia coli (strain K12) P33363 BGLX ECOLI
MKWLCSVGIAVSLALQPALA

SEQ ID NO: 481 - protein, 20 aa, Escherichia coli
  misc feature (1)..(20): Escherichia coli (strain ATCC 8739/DSM 1576/Crooks) B1ISR2 B1ISR2 ECOLC
MKKVAAFVALSLLMAGCVSN

SEQ ID NO: 482 - protein, 20 aa, Escherichia coli
  misc feature (1)..(20): Escherichia coli (strain ATCC 8739/DSM 1576/Crooks) B1IPP4 B1IPP4 ECOLC
MRKIALILAMLLIPCVSFAG

SEQ ID NO: 483 - protein, 20 aa, Escherichia coli
  misc feature (1)..(20): Escherichia coli Q1X7X1 Q1X7X1 ECOLX
MRLKYILIIPLLLISLSVFA

SEQ ID NO: 484 - protein, 20 aa, Escherichia coli
  misc feature (1)..(20): Escherichia coli O157:H7 P69778 LPP ECO57
MKATKLVLGAVILGSTLLAG

SEQ ID NO: 485 - protein, 20 aa, Escherichia coli
  misc feature (1)..(20): Escherichia coli (strain K12) P37056 YAEF ECOLI
MDKPKAYCRLFLPSFLLLSA

SEQ ID NO: 486 - protein, 20 aa, Escherichia coli
  misc feature (1)..(20): Escherichia coli O139:H28 (strain E24377A/ETEC) A7ZK68 YCCT ECO24
MKTGIVTTLIALCLPVSVFA

SEQ ID NO: 487 - protein, 20 aa, Escherichia coli
  misc feature (1)..(20): Escherichia coli O157:H7 Q8X8F2 OMPL ECO57
MKNINAIILLSSLTSASVFA

SEQ ID NO: 488 - protein, 20 aa, Escherichia coli
  misc feature (1)..(20): Escherichia coli (strain K12) Q46863 YGIS ECOLI
MYTRNLLWLVSLVSAAPLYA

SEQ ID NO: 489 - protein, 20 aa, Escherichia coli
  misc feature (1)..(20): Escherichia coli Q541E8 Q541E8 ECOLX
MKKINAIILLSSLTSASVFA

SEQ ID NO: 490 - protein, 20 aa, Escherichia coli
  misc feature (1)..(20): Escherichia coli Q47099 Q47099 ECOLX
MKKVTLFLFAASLLPSCVLA

SEQ ID NO: 491 - protein, 20 aa, Escherichia coli
  misc feature (1)..(20): Escherichia coli (strain ATCC 8739/DSM 1576/Crooks) B1IY63 ECOT ECOLC
MKTILPAVLFAAFATTSAWA

SEQ ID NO: 492 - protein, 20 aa, Escherichia coli
  misc feature (1)..(20): Escherichia coli (strain ATCC 8739/DSM 1576/Crooks) B1IZJ7 B1IZJ7 ECOLC
MKACLLLFFYFSFICQLHGA

SEQ ID NO: 493 - protein, 20 aa, Escherichia coli
  misc feature (1)..(20): Escherichia coli (strain K12) P0A935 MLTA ECOLI
MKGRWVKYLLMGTVVAMLAA

SEQ ID NO: 494 - protein, 20 aa, Escherichia coli
  misc feature (1)..(20): Escherichia coli O6:K15:H31 (strain 536/UPEC) Q0TFN2 ECOT ECOL5
MKTILPAVLFAAFATTSAWA

SEQ ID NO: 495 - protein, 20 aa, Escherichia coli
  misc feature (1)..(20): Escherichia coli P20862 FANH ECOLX
MIKKVPVLLFFMASISITHA

SEQ ID NO: 496 - protein, 20 aa, Escherichia coli
  misc feature (1)..(20): Escherichia coli O6 P0AEU8 SKP ECOL6
MKKWLLAAGLGLALATSAQA

SEQ ID NO: 497 - protein, 20 aa, Escherichia coli
  misc feature (1)..(20): Escherichia coli Q1X7X4 Q1X7X4 ECOLX
MRLKYILIIPLLLISLSVFA

SEQ ID NO: 498 - protein, 20 aa, Escherichia coli
  misc feature (1)..(20): Escherichia coli O157:H7 P0A931 WZA ECO57
MMKSKMKLMPLLVSVTLISG

SEQ ID NO: 499 - protein, 20 aa, Escherichia coli
  misc feature (1)..(20): Escherichia coli O1:K1/APEC A1A7M1 YAET ECOK1
MAMKKLLIASLLFSSATVYG

SEQ ID NO: 500 - protein, 20 aa, Escherichia coli
  misc feature (1)..(20): Escherichia coli (strain ATCC 8739/DSM 1576/Crooks) B1IX52 B1IX52 ECOLC
MKKIICLVITLLMTLPVYAK

SEQ ID NO: 501 - protein, 20 aa, Escherichia coli
  misc feature (1)..(20): Escherichia coli (strain K12) P0AEG6 DSBC ECOLI
MKKGFMLFTLLAAFSGFAQA

SEQ ID NO: 502 - protein, 20 aa, Escherichia coli
  misc feature (1)..(20): Escherichia coli (strain UTI89/UPEC) Q1R9K8 ECOT ECOUT
MKTILPAVLFAAFATTSAWA

SEQ ID NO: 503 - protein, 20 aa, Escherichia coli
  misc feature (1)..(20): Escherichia coli (strain ATCC 8739/DSM 1576/Crooks) B1IYY7 B1IYY7 ECOLC
MKRKIIVACGGAVATSTMAA

SEQ ID NO: 504 - protein, 20 aa, Escherichia coli
  misc feature (1)..(20): Escherichia coli Q1X7W6 Q1X7W6 ECOLX
MRLKYILIIPLLLISLSVFA

SEQ ID NO: 505 - protein, 20 aa, Escherichia coli
  misc feature (1)..(20): Escherichia coli (strain ATCC 8739/DSM 1576/Crooks) B1IQ46 B1IQ46 ECOLC
MRRLPGILLLTGAALVVIAA

SEQ ID NO: 506 - protein, 20 aa, Escherichia coli
  misc feature (1)..(20): Escherichia coli (strain ATCC 8739/DSM 1576/Crooks) B1ITP6 B1ITP6 ECOLC
MFKTTLCALLITASCSTFAA

SEQ ID NO: 507 - protein, 20 aa, Escherichia coli
  misc feature (1)..(20): Escherichia coli (strain K12) P0ABZ6 SURA ECOLI
MKNWKTLLLGIAMIANTSFA

SEQ ID NO: 508 - protein, 20 aa, Escherichia coli
  misc feature (1)..(20): Escherichia coli O6 Q8CW54 FLGI ECOL6
MVIKFLSALILLLVTTAVQA

SEQ ID NO: 509 - protein, 20 aa, Escherichia coli
  misc feature (1)..(20): Escherichia coli (strain K12) P75906 PGAB ECOLI
MLRNGNKYLLMLVSIIMLTA

SEQ ID NO: 510 - protein, 20 aa, Escherichia coli
  misc feature (1)..(20): Escherichia coli (strain ATCC 8739/DSM 1576/Crooks) B1IU11 B1IU11 ECOLC
MKKWAVIISAVGLAFAVSGC

SEQ ID NO: 511 - protein, 20 aa, Escherichia coli
  misc feature (1)..(20): Escherichia coli P32885 TRAT2 ECOLX
MKMKKLMMVALVSSTLALSG

SEQ ID NO: 512 - protein, 20 aa, Escherichia coli
  misc feature (1)..(20): Escherichia coli (strain K12) P37325 YBCH ECOLI
MRKFIFVLLTLLLVSPFSFA

SEQ ID NO: 513 - protein, 20 aa, Escherichia coli
  misc feature (1)..(20): Escherichia coli Q1X7X7 Q1X7X7 ECOLX
MRLKYILIIPLLLISLSVFA

SEQ ID NO: 514 - protein, 20 aa, Escherichia coli
  misc feature (1)..(20): Escherichia coli (strain K12) P64451 YDCL ECOLI
MRTTSFAKVAALCGLLALSG

SEQ ID NO: 515 - protein, 20 aa, Escherichia coli
  misc feature (1)..(20): Escherichia coli P42213 KPSD5 ECOLX
MKLFKSILLIAACHAAQASA

SEQ ID NO: 516 - protein, 20 aa, Escherichia coli
  misc feature (1)..(20): Escherichia coli (strain K12) P0AF86 YJFY ECOLI
MFSRVLALLAVLLLSANTWA

SEQ ID NO: 517 - protein, 20 aa, Escherichia coli
  misc feature (1)..(20): Escherichia coli O111:NM Q1ELX8 Q1ELX8 ECOLX
MKKTLLIAASLSFFSASALA

SEQ ID NO: 518 - protein, 20 aa, Escherichia coli
  misc feature (1)..(20): Escherichia coli (strain ATCC 8739/DSM 1576/Crooks) B1IV63 B1IV63 ECOLC
MRVKHAVVLLMLISPLSWAG

SEQ ID NO: 519 - protein, 20 aa, Escherichia coli
  misc feature (1)..(20): Escherichia coli Q8X4M7 Q8X4M7 ECOLX
MKKTLLIAASLSFFSASALA

SEQ ID NO: 520 - protein, 20 aa, Escherichia coli
  misc feature (1)..(20): Escherichia coli Q1X7W7 Q1X7W7 ECOLX
MRLKYILIIPLLLISLSVFA

SEQ ID NO: 521 - protein, 20 aa, Escherichia coli
  misc feature (1)..(20): Escherichia coli (strain UTI89/UPEC) Q1R3U1 BTUB ECOUT
MIKKASLLTACSVTAFSAWA

SEQ ID NO: 522 - protein, 20 aa, Escherichia coli
  misc feature (1)..(20): Escherichia coli (strain ATCC 8739/DSM 1576/Crooks) B1IZX6 B1IZX6 ECOLC
MKKLAIAGALMLLAGCAEVE

SEQ ID NO: 523 - protein, 20 aa, Escherichia coli
  misc feature (1)..(20): Escherichia coli (strain ATCC 8739/DSM 1576/Crooks) B1IV22 B1IV22 ECOLC
MIKFLSALILLLVTTAAQAE

SEQ ID NO: 524 - protein, 20 aa, Escherichia coli
  misc feature (1)..(20): Escherichia coli (strain ATCC 8739/DSM 1576/Crooks) B1IPS5 B1IPS5 ECOLC
MKIKNTFFVILMLSLPAISA

SEQ ID NO: 525 - protein, 21 aa, Escherichia coli
  misc feature (1)..(21): Escherichia coli (strain ATCC 8739/DSM 1576/Crooks) B1J102 B1J102 ECOLC
MQKILGLLVVLGCVFGGYFEA

SEQ ID NO: 526 - protein, 21 aa, Escherichia coli
  misc feature (1)..(21): Escherichia coli (strain ATCC 8739/DSM 1576/Crooks) B1IQU1 B1IQU1 ECOLC
MRFSRFIIGLTSCIAFSVQAA

SEQ ID NO: 527 - protein, 21 aa, Escherichia coli
  misc feature (1)..(21): Escherichia coli Q47487 Q47487 ECOLX
MKQSTIALALLPLLFTPVTKA

SEQ ID NO: 528 - protein, 21 aa, Escherichia coli
  misc feature (1)..(21): Escherichia coli Q47488 Q47488 ECOLX
MKQSTIALALLPLLFTPVTKA

SEQ ID NO: 529 - protein, 21 aa, Escherichia coli
  misc feature (1)..(21): Escherichia coli Q2PQI4 Q2PQI4 ECOLX
MKKTLIALAIAASAASGMAHA

SEQ ID NO: 530 - protein, 21 aa, Escherichia coli
  misc feature (1)..(21): Escherichia coli P0A1V9 BLO2 ECOLX
MAIRIFAILFSIFSLATFAHA

SEQ ID NO: 531 - protein, 21 aa, Escherichia coli
  misc feature (1)..(21): Escherichia coli (strain K12) P0A6S0 FLGH ECOLI
MQKNAAHTYAISSLLVLSLTG

SEQ ID NO: 532 - protein, 21 aa, Escherichia coli
  misc feature (1)..(21): Escherichia coli Q708I7 Q708I7 ECOLX
MKKTLIALAIAASAASGMAHA

SEQ ID NO: 533 - protein, 21 aa, Escherichia coli
  misc feature (1)..(21): Escherichia coli O6 P62610 FOCC ECOL6
MRIWAVLASFLVFFYIPQSYA

SEQ ID NO: 534 - protein, 21 aa, Escherichia coli
  misc feature (1)..(21): Escherichia coli O157:H7 P0AFM3 PROX ECO57
MRHSVLFATAFATLISTQTFA

SEQ ID NO: 535 - protein, 21 aa, Escherichia coli
  misc feature (1)..(21): Escherichia coli Q47486 Q47486 ECOLX
MKQSTIALALLPLLFTPVTKA

SEQ ID NO: 536 - protein, 21 aa, Escherichia coli
  misc feature (1)..(21): Escherichia coli (strain K12) P61316 LOLA ECOLI
MKKIAITCALLSSLVASSVWA

SEQ ID NO: 537 - protein, 21 aa, Escherichia coli
  misc feature (1)..(21): Escherichia coli P15319 PAPD ECOLX
MIRKKILMAAIPLFVISGADA

SEQ ID NO: 538 - protein, 21 aa, Escherichia coli
  misc feature (1)..(21): Escherichia coli O157:H7 P65291 YFGH ECO57
MMKFKKCLLPVAMLASFTLAG

SEQ ID NO: 539 - protein, 21 aa, Escherichia coli
  misc feature (1)..(21): Escherichia coli P08180 AFAE1 ECOLX
MKKLAIIGATSVMMMTGTAQA

SEQ ID NO: 540 - protein, 21 aa, Escherichia coli
  misc feature (1)..(21): Escherichia coli (strain ATCC 8739/DSM 1576/Crooks) B1IVB2 B1IVB2 ECOLC
MIKKASLLTACSVTAFSAWAQ

SEQ ID NO: 541 - protein, 21 aa, Escherichia coli
  misc feature (1)..(21): Escherichia coli O6:K15:H31 (strain 536/UPEC) Q0THN1 ASR ECOL5
MKKVLALVVAAAMGLSSAAFA

SEQ ID NO: 542 - protein, 21 aa, Escherichia coli
  misc feature (1)..(21): Escherichia coli Q47195 Q47195 ECOLX
MIKSVIAGAVAMAVVSFGVNA

SEQ ID NO: 543 - protein, 21 aa, Escherichia coli
  misc feature (1)..(21): Escherichia coli Q47196 Q47196 ECOLX
MRKIQFILGILAAASSSATLA

SEQ ID NO: 544 - protein, 21 aa, Escherichia coli
  misc feature (1)..(21): Escherichia coli O157:H7 P0AC06 FLIP ECO57
MRRLLSVAPVLLWLITPLAFA

SEQ ID NO: 545 - protein, 21 aa, Escherichia coli
  misc feature (1)..(21): Escherichia coli (strain ATCC 8739/DSM 1576/Crooks) B1IYX3 B1IYX3 ECOLC
MEIRIMLFILMMMVMPVSYAA

SEQ ID NO: 546 - protein, 21 aa, Escherichia coli
  misc feature (1)..(21): Escherichia coli (strain ATCC 8739/DSM 1576/Crooks) B1IVC5 B1IVC5 ECOLC
MAYLVAVTACVSGVAHTYMAA

SEQ ID NO: 547 - protein, 21 aa, Escherichia coli
  misc feature (1)..(21): Escherichia coli (strain K12) P64534 YOHN ECOLI
MTIKNKMLLGALLLVTSAAWA

SEQ ID NO: 548 - protein, 21 aa, Escherichia coli
  misc feature (1)..(21): Escherichia coli (strain K12) P77368 YBCL ECOLI
MKTLIVSTVLAFITFSAQAAA

SEQ ID NO: 549 - protein, 21 aa, Escherichia coli
  misc feature (1)..(21): Escherichia coli (strain K12) P33013 DACD ECOLI
MKRRLIIAASLFVFNLSSGFA

SEQ ID NO: 550 - protein, 21 aa, Escherichia coli
  misc feature (1)..(21): Escherichia coli Q2PQI8 Q2PQI8 ECOLX
MKKTLIALAIAASAASGMAHA

SEQ ID NO: 551 - protein, 21 aa, Escherichia coli
  misc feature (1)..(21): Escherichia coli O157:H7 P0AF47 YJBE ECO57
MKKVLYGIFAISALAATSAWA

SEQ ID NO: 552 - protein, 21 aa, Escherichia coli
  misc feature (1)..(21): Escherichia coli (strain K12) P00634 PPB ECOLI
MKQSTIALALLPLLFTPVTKA

SEQ ID NO: 553 - protein, 21 aa, Escherichia coli
  misc feature (1)..(21): Escherichia coli P04738 FAEC ECOLX
MKKAFLLACVFFLTGGGVSHA

SEQ ID NO: 554 - protein, 21 aa, Escherichia coli
  misc feature (1)..(21): Escherichia coli Q708I6 Q708I6 ECOLX
MKKTLIALAIAASAASGMAHA

SEQ ID NO: 555 - protein, 21 aa, Escherichia coli
  misc feature (1)..(21): Escherichia coli (strain K12) P37651 GUN ECOLI
MNVLRSGIVTMLLLAAFSVQA

SEQ ID NO: 556 - protein, 21 aa, Escherichia coli
  misc feature (1)..(21): Escherichia coli (strain ATCC 8739/DSM 1576/Crooks) B1IWN2 LOLA ECOLC
MKKIAITCALLSSLVASSVWA

SEQ ID NO: 557 - protein, 21 aa, Escherichia coli
  misc feature (1)..(21): Escherichia coli (strain ATCC 8739/DSM 1576/Crooks) B1IUG8 B1IUG8 ECOLC
MKKVLLIILLLLVVLGIAAGV

SEQ ID NO: 558 - protein, 21 aa, Escherichia coli
  misc feature (1)..(21): Escherichia coli (strain K12) P0AF82 YJFN ECOLI
MKQLLASPSLQLVTYPASATA

SEQ ID NO: 559 - protein, 21 aa, Escherichia coli
  misc feature (1)..(21): Escherichia coli O1:K1/APEC A1AE89 MLTF ECOK1
MKKLKINYLFIGILALLLAVA

SEQ ID NO: 560 - protein, 21 aa, Escherichia coli
  misc feature (1)..(21): Escherichia coli (strain ATCC 8739/DSM 1576/Crooks) B1IUH0 B1IUH0 ECOLC
MSKRRVVVTGLGMLSPVGNTV

SEQ ID NO: 561 - protein, 21 aa, Escherichia coli
  misc feature (1)..(21): Escherichia coli (strain ATCC 8739/DSM 1576/Crooks) B1IRL6 B1IRL6 ECOLC
MKYRIALAVSLFALSAGSYAT

SEQ ID NO: 562 - protein, 21 aa, Escherichia coli
  misc feature (1)..(21): Escherichia coli (strain ATCC 8739/DSM 1576/Crooks) B1ITA9 B1ITA9 ECOLC
MKKGFMLFTLLAAFSGFAQAD

SEQ ID NO: 563 - protein, 21 aa, Escherichia coli
  misc feature (1)..(21): Escherichia coli Q2PQI5 Q2PQI5 ECOLX
MKKTLIALAIAASAASGMAHA

SEQ ID NO: 564 - protein, 21 aa, Escherichia coli
  misc feature (1)..(21): Escherichia coli (strain ATCC 8739/DSM 1576/Crooks) B1IX76 B1IX76 ECOLC
MAIKKRSATVVPGASGAAAAV

SEQ ID NO: 565 - protein, 21 aa, Escherichia coli
  misc feature (1)..(21): Escherichia coli (strain ATCC 8739/DSM 1576/Crooks) B1IVC8 B1IVC8 ECOLC
MTKIIAVTACPSGVAHTYMAA

SEQ ID NO: 566 - protein, 21 aa, Escherichia coli
  misc feature (1)..(21): Escherichia coli O6:K15:H31 (strain 536/UPEC) Q0TJV4 TOLB ECOL5
MKQALRVAFGFLILWASVLHA

SEQ ID NO: 567 - protein, 21 aa, Escherichia coli
  misc feature (1)..(21): Escherichia coli (strain K12) P64542 YPEC ECOLI
MFRSLFLAAALMAFTPLAANA

SEQ ID NO: 568 - protein, 21 aa, Escherichia coli
  misc feature (1)..(21): Escherichia coli Q9ALL6 Q9ALL6 ECOLX
MKKKLLIASVLAMATVSGSVL

SEQ ID NO: 569 - protein, 21 aa, Escherichia coli
  misc feature (1)..(21): Escherichia coli (strain ATCC 8739/DSM 1576/Crooks) B1IY12 B1IY12 ECOLC
MTFMKGLPLLLLVASLCSHAA

SEQ ID NO: 570 - protein, 21 aa, Escherichia coli
  misc feature (1)..(21): Escherichia coli (strain K12) P31058 YADC ECOLI
MKTIFRYILFLALYSCCNTVS

SEQ ID NO: 571 - protein, 21 aa, Escherichia coli
  misc feature (1)..(21): Escherichia coli (strain K12) P0AF45 YJBE ECOLI
MKKVLYGIFAISALAATSAWA

SEQ ID NO: 572 - protein, 21 aa, Escherichia coli
  misc feature (1)..(21): Escherichia coli (strain K12) P39325 YTFQ ECOLI
MWKRLLIVSAVSAAMSSMALA

SEQ ID NO: 573 - protein, 21 aa, Escherichia coli
  misc feature (1)..(21): Escherichia coli (strain K12) P0AE85 CPXP ECOLI
MRIVTAAVMASTLAVSSLSHA

SEQ ID NO: 574 - protein, 21 aa, Escherichia coli
  misc feature (1)..(21): Escherichia coli P42188 PRSG ECOLX
MKKWLPAFLFLSLSGCNDALA

SEQ ID NO: 575 - protein, 21 aa, Escherichia coli
  misc feature (1)..(21): Escherichia coli O6 P0AE86 CPXP ECOL6
MRIVTAAVMASTLAVSSLSHA

SEQ ID NO: 576 - protein, 21 aa, Escherichia coli
  misc feature (1)..(21): Escherichia coli P32890 ELBP ECOLX
MNKVKCYVLFTALLSSLYAHG

SEQ ID NO: 577 - protein, 21 aa, Escherichia coli
  misc feature (1)..(21): Escherichia coli O6 P0AF46 YJBE ECOL6
MKKVLYGIFAISALAATSAWA

SEQ ID NO: 578 - protein, 21 aa, Escherichia coli
  misc feature (1)..(21): Escherichia coli P02987 LYS0 ECOLX
MKKAKAIFLFILIVSGFLLVA

SEQ ID NO: 579 - protein, 21 aa, Escherichia coli
  misc feature (1)..(21): Escherichia coli O139:H28 (strain E24377A/ETEC) A7ZJW0 LOLA ECO24
MKKIAITCALLSSLVASSVWA

SEQ ID NO: 580 - protein, 21 aa, Escherichia coli
  misc feature (1)..(21): Escherichia coli (strain K12) P76397 MDTA ECOLI
MKGSYKSRWVIVIVVVIAAIA

SEQ ID NO: 581 - protein, 21 aa, Escherichia coli
  misc feature (1)..(21): Escherichia coli (strain ATCC 8739/DSM 1576/Crooks) B1ISM2 B1ISM2 ECOLC
MAAVCGTSGIASLFSQAAFAA

SEQ ID NO: 582 - protein, 21 aa, Escherichia coli
  misc feature (1)..(21): Escherichia coli (strain K12) P61320 LOLB ECOLI
MPLPDFRLIRLLPLAALVLTA

SEQ ID NO: 583 - protein, 21 aa, Escherichia coli
  misc feature (1)..(21): Escherichia coli Q46668 CDTA ECOLX
MANKRTPIFIAGILIPILLNG

SEQ ID NO: 584 - protein, 21 aa, Escherichia coli
  misc feature (1)..(21): Escherichia coli (strain K12) P65290 YFGH ECOLI
MMKFKKCLLPVAMLASFTLAG

SEQ ID NO: 585 - protein, 21 aa, Escherichia coli
  misc feature (1)..(21): Escherichia coli (strain K12) P0ABK7 CSGB ECOLI
MKNKLLFMMLTILGAPGIAAA

SEQ ID NO: 586 - protein, 21 aa, Escherichia coli
  misc feature (1)..(21): Escherichia coli O157:H7 Q8XA45 MLTF ECO57
MKKLKINYLFIGILALLLAVA

SEQ ID NO: 587 - protein, 21 aa, Escherichia coli
  misc feature (1)..(21): Escherichia coli O157:H7 P0A911 OMPA ECO57
MKKTAIAIAVALAGFATVAQA

SEQ ID NO: 588 - protein, 21 aa, Escherichia coli
  misc feature (1)..(21): Escherichia coli O52984 O52984 ECOLX
MTLKDTLFFLSISIYCSQSLA

SEQ ID NO: 589 - protein, 21 aa, Escherichia coli
  misc feature (1)..(21): Escherichia coli P20861 FANG ECOLX
MKKLYKAITVICILMSNLQSA

SEQ ID NO: 590 - protein, 21 aa, Escherichia coli
  misc feature (1)..(21): Escherichia coli (strain ATCC 8739/DSM 1576/Crooks) B1ISD2 B1ISD2 ECOLC
MKKFAAVIAVMALCSAPVMAA

SEQ ID NO: 591 - protein, 21 aa, Escherichia coli
  misc feature (1)..(21): Escherichia coli (strain K12) P0AGC5 MLTF ECOLI
MKKLKINYLFIGILALLLAVA

SEQ ID NO: 592 - protein, 21 aa, Escherichia coli
  misc feature (1)..(21): Escherichia coli O6 Q8FF25 MLTF ECOL6
MKKLKINYLFIGILALLLAVA

SEQ ID NO: 593 - protein, 21 aa, Escherichia coli
  misc feature (1)..(21): Escherichia coli P14191 FAEG3 ECOLX
MKKTLIALAIAASAASGMAHA

SEQ ID NO: 594 - protein, 21 aa, Escherichia coli
  misc feature (1)..(21): Escherichia coli O157:H7 Q8XE41 OMPC ECO57
MKVKVLSLLVPALLVAGAANA

SEQ ID NO: 595 - protein, 21 aa, Escherichia coli
  misc feature (1)..(21): Escherichia coli (strain K12) P0AB31 YCEK ECOLI
MRLIVVSIMVTLLSGCGSIIS

SEQ ID NO: 596 - protein, 21 aa, Escherichia coli
  misc feature (1)..(21): Escherichia coli O6 P64535 YOHN ECOL6
MTIKNKMLLGALLLVTSAAWA

SEQ ID NO: 597 - protein, 21 aa, Escherichia coli
  misc feature (1)..(21): Escherichia coli (strain ATCC 8739/DSM 1576/Crooks) B1J0H4 B1J0H4 ECOLC
MKPMHIAMALLSAAMFFVLAG

SEQ ID NO: 598 - protein, 21 aa, Escherichia coli
  misc feature (1)..(21): Escherichia coli (strain K12) P37681 YIAT ECOLI
MLINRNIVALFALPFMASATA

SEQ ID NO: 599 - protein, 21 aa, Escherichia coli
  misc feature (1)..(21): Escherichia coli O9:H4 (strain HS) A8A1U6 MDTA ECOHS
MKGSYKSRWVIVIVVVIAAIA

SEQ ID NO: 600 - protein, 21 aa, Escherichia coli
  misc feature (1)..(21): Escherichia coli (strain K12) P76176 YDGD ECOLI
MRTTIAVVLGAISLTSAFVFA

SEQ ID NO: 601 - protein, 21 aa, Escherichia coli
  misc feature (1)..(21): Escherichia coli Q57254 AFAE3 ECOLX
MKKLAIMAAASMVFAVSSAHA

SEQ ID NO: 602 - protein, 21 aa, Escherichia coli
  misc feature (1)..(21): Escherichia coli O6 Q8CW15 ASR ECOL6
MKKVLALVVAAAMGLSSAAFA

SEQ ID NO: 603 - protein, 21 aa, Escherichia coli
  misc feature (1)..(21): Escherichia coli P15483 CS31 ECOLX
MTPIKLIFAALSLFPCSNIYA

SEQ ID NO: 604 - protein, 21 aa, Escherichia coli
  misc feature (1)..(21): Escherichia coli O157:H7 P58224 YIAT ECO57
MLINRNIVALFALPFMASATA

SEQ ID NO: 605 - protein, 21 aa, Escherichia coli
  misc feature (1)..(21): Escherichia coli (strain ATCC 8739/DSM 1576/Crooks) B1IUM3 B1IUM3 ECOLC
MKKRHLLSLLALGISMACYGE

SEQ ID NO: 606 - protein, 21 aa, Escherichia coli
  misc feature (1)..(21): Escherichia coli P25394 FMF7 ECOLX
MKRLVFISFVALSMTAGSAMA

SEQ ID NO: 607 - protein, 21 aa, Escherichia coli
  misc feature (1)..(21): Escherichia coli (strain ATCC 8739/DSM 1576/Crooks) B1ISH0 B1ISH0 ECOLC
MSSRLIIALIIMLLAPGVQAH

SEQ ID NO: 608 - protein, 21 aa, Escherichia coli
  misc feature (1)..(21): Escherichia coli (strain ATCC 8739/DSM 1576/Crooks) B1IT49 B1IT49 ECOLC
MMRKMLLAAALSVTAMTAHAD

SEQ ID NO: 609 - protein, 21 aa, Escherichia coli
  misc feature (1)..(21): Escherichia coli (strain SMS-3-5/SECEC) B1LP71 MLTF ECOSM
MKKLKINYLFIGILALLLAVA

SEQ ID NO: 610 - protein, 21 aa, Escherichia coli
  misc feature (1)..(21): Escherichia coli P13720 PAPG ECOLX
MKKWFPAFLFLSLSGGNDALA

SEQ ID NO: 611 - protein, 21 aa, Escherichia coli
  misc feature (1)..(21): Escherichia coli O139:H28 (strain E24377A/ETEC) A7ZKI4 FLGH ECO24
MQKNAAHTYAISSLLVLSLTG

SEQ ID NO: 612 - protein, 21 aa, Escherichia coli
  misc feature (1)..(21): Escherichia coli (strain K12) P75853 SSUA ECOLI
MRNIIKLALAGLLSVSTFAVA

SEQ ID NO: 613 - protein, 21 aa, Escherichia coli
  misc feature (1)..(21): Escherichia coli O157:H7 Q8X659 MDTQ ECO57
MNRDSFYPAIACFPLLLMLAG

SEQ ID NO: 614 - protein, 21 aa, Escherichia coli
  misc feature (1)..(21): Escherichia coli (strain ATCC 8739/DSM 1576/Crooks) B1IVR9 MLTF ECOLC
MKKLKINYLFIGILALLLAVA

SEQ ID NO: 615 - protein, 21 aa, Escherichia coli
  misc feature (1)..(21): Escherichia coli (strain ATCC 8739/DSM 1576/Crooks) B1IPQ6 B1IPQ6 ECOLC
MKKILVSFVAIMAVTSTAMAA

SEQ ID NO: 616 - protein, 21 aa, Escherichia coli
  misc feature (1)..(21): Escherichia coli O6 P0ADB8 ECNB ECOL6
MVKKTIAAIFSVLVLSTVLTA

SEQ ID NO: 617 - protein, 21 aa, Escherichia coli
  misc feature (1)..(21): Escherichia coli O157:H7 P0A857 TOLB ECO57
MKQALRVAFGFLILWASVLHA

SEQ ID NO: 618 - protein, 21 aa, Escherichia coli
  misc feature (1)..(21): Escherichia coli (strain K12) P15028 FECB ECOLI
MLAFIRFLFAGLLLVISHAFA

SEQ ID NO: 619 - protein, 21 aa, Escherichia coli
  misc feature (1)..(21): Escherichia coli (strain ATCC 8739/DSM 1576/Crooks) B1IRC3 B1IRC3 ECOLC
MKNWKTLLLGIAMIANTSFAA

SEQ ID NO: 620 - protein, 21 aa, Escherichia coli
  misc feature (1)..(21): Escherichia coli O6:K15:H31 (strain 536/UPEC) Q0TG16 MDTA ECOL5
MKGSYKSRWVIVIVVVIAAIA

SEQ ID NO: 621 - protein, 21 aa, Escherichia coli
  misc feature (1)..(21): Escherichia coli (strain K12) P76498 YFCO ECOLI
MKILRWLFALVMLIATTEAMA

SEQ ID NO: 622 - protein, 21 aa, Escherichia coli
  misc feature (1)..(21): Escherichia coli P42191 PRSK ECOLX
MIKSTGALLLFAALSAGQAMA

SEQ ID NO: 623 - protein, 21 aa, Escherichia coli
  misc feature (1)..(21): Escherichia coli (strain ATCC 8739/DSM 1576/Crooks) B1ISD6 B1ISD6 ECOLC
MYTRNLLWLVSLVSAAPLYAA

SEQ ID NO: 624 - protein, 21 aa, Escherichia coli
  misc feature (1)..(21): Escherichia coli O157:H7 Q8X5L9 GUN ECO57
MNVLRSGLVTMLLLAAFSVQA

SEQ ID NO: 625 - protein, 21 aa, Escherichia coli
  misc feature (1)..(21): Escherichia coli (strain K12) P76471 YFAZ ECOLI
MKKIALAGLAGMLLVSASVNA

SEQ ID NO: 626 - protein, 21 aa, Escherichia coli
  misc feature (1)..(21): Escherichia coli (strain K12) P0A910 OMPA ECOLI
MKKTAIAIAVALAGFATVAQA

SEQ ID NO: 627 - protein, 21 aa, Escherichia coli
  misc feature (1)..(21): Escherichia coli P13719 DAAE ECOLX
MKKLAIMAAASMIFTVGSAQA

SEQ ID NO: 628 - protein, 21 aa, Escherichia coli
  misc feature (1)..(21): Escherichia coli P04740 FMK1 ECOLX
MIKSVIAGAVAMAVVSFGANA

SEQ ID NO: 629 - protein, 21 aa, Escherichia coli
  misc feature (1)..(21): Escherichia coli O139:H28 (strain E24377A/ETEC) A7ZKY3 LOLB ECO24
MPLPDFRLIRLLPLAALVLTA

SEQ ID NO: 630 - protein, 21 aa, Escherichia coli
  misc feature (1)..(21): Escherichia coli (strain K12) P76045 OMPG ECOLI
MKKLLPCTALVMCAGMACAQA

SEQ ID NO: 631 - protein, 21 aa, Escherichia coli
  misc feature (1)..(21): Escherichia coli O6 P62533 PAPK ECOL6
MIKSTGALLLFAALSAGQAIA

SEQ ID NO: 632 - protein, 21 aa, Escherichia coli
  misc feature (1)..(21): Escherichia coli (strain ATCC 8739/DSM 1576/Crooks) B1IZE0 B1IZE0 ECOLC
MKLVHMASGLAVAIALAACAD

SEQ ID NO: 633 - protein, 21 aa, Escherichia coli
  misc feature (1)..(21): Escherichia coli (strain K12) P76076 YDBL ECOLI
MKKTLLLCAFLVGLVSSNVMA

SEQ ID NO: 634 - protein, 21 aa, Escherichia coli
  misc feature (1)..(21): Escherichia coli P62609 FOCC ECOLX
MRIWAVLASFLVFFYIPQSYA

SEQ ID NO: 635 - protein, 21 aa, Escherichia coli
  misc feature (1)..(21): Escherichia coli (strain K12) P75750 YBGQ ECOLI
MNIYRLSFVSCLVMAMPCAMA

SEQ ID NO: 636 - protein, 21 aa, Escherichia coli
  misc feature (1)..(21): Escherichia coli Q9S169 BLA24 ECOLX
MRYIRLCIISLLATLPLAVHA

SEQ ID NO: 637 - protein, 21 aa, Escherichia coli
  misc feature (1)..(21): Escherichia coli (strain K12) P64481 YDJM ECOLI
MSFIMTAEGHLLFSIACAVFA

SEQ ID NO: 638 - protein, 21 aa, Escherichia coli
  misc feature (1)..(21): Escherichia coli (strain K12) Q47622 SAPA ECOLI
MRQVLSSLLVIAGLVSGQAIA

SEQ ID NO: 639 - protein, 21 aa, Escherichia coli
  misc feature (1)..(21): Escherichia coli O6 Q8CW55 FLGH ECOL6
MQKNAAHTYAISSLLVLSLTG

SEQ ID NO: 640 - protein, 21 aa, Escherichia coli
  misc feature (1)..(21): Escherichia coli (strain K12) P75694 YAHO ECOLI
MKIISKMLVGALALAVTNVYA

SEQ ID NO: 641 - protein, 21 aa, Escherichia coli
  misc feature (1)..(21): Escherichia coli (strain ATCC 8739/DSM 1576/Crooks) B1IXY9 TOLB ECOLC
MKQALRVAFGFLILWASVLHA

SEQ ID NO: 642 - protein, 21 aa, Escherichia coli
  misc feature (1)..(21): Escherichia coli O157:H7 P58402 EVGS ECO57
MKFLPYIFLLCCGLWSTISFA

SEQ ID NO: 643 - protein, 21 aa, Escherichia coli
  misc feature (1)..(21): Escherichia coli (strain ATCC 8739/DSM 1576/Crooks) B1IQB5 B1IQB5 ECOLC
MKKLLIIILPVLLSGCSAFNQ

SEQ ID NO: 644 - protein, 21 aa, Escherichia coli
  misc feature (1)..(21): Escherichia coli O157:H7 P58403 YFDX ECO57
MKRLIMATMVTAILASSTVWA

SEQ ID NO: 645 - protein, 21 aa, Escherichia coli
  misc feature (1)..(21): Escherichia coli (strain K12) P76656 YQII ECOLI
MRYLLIVITFFMGFSSLPAWA

SEQ ID NO: 646 - protein, 21 aa, Escherichia coli
  misc feature (1)..(21): Escherichia coli (strain ATCC 8739/DSM 1576/Crooks) B1IPS4 B1IPS4 ECOLC
MKNIVLASLLGFGLISSAWAT

SEQ ID NO: 647 - protein, 21 aa, Escherichia coli
  misc feature (1)..(21): Escherichia coli (strain ATCC 8739/DSM 1576/Crooks) B1IVD3 B1IVD3 ECOLC
MKASLALLSLLTAFTSHSLKS

SEQ ID NO: 648 - protein, 21 aa, Escherichia coli
  misc feature (1)..(21): Escherichia coli Q47192 Q47192 ECOLX
MKKWFPAFLFLSLSGCNDALA

SEQ ID NO: 649 - protein, 21 aa, Escherichia coli
  misc feature (1)..(21): Escherichia coli Q9ALL1 Q9ALL1 ECOLX
MRKITSLIMAVTLMNSSAFAA

SEQ ID NO: 650 - protein, 21 aa, Escherichia coli
  misc feature (1)..(21): Escherichia coli (strain ATCC 8739/DSM 1576/Crooks) B1ISM7 B1ISM7 ECOLC
MKKLALILFMGTLVSFYADAG

SEQ ID NO: 651 - protein, 21 aa, Escherichia coli
  misc feature (1)..(21): Escherichia coli (strain ATCC 8739/DSM 1576/Crooks) B1IUX3 B1IUX3 ECOLC
MVSALITVAVIAWCAQLALGG

SEQ ID NO: 652 - protein, 21 aa, Escherichia coli
  misc feature (1)..(21): Escherichia coli (strain ATCC 8739/DSM 1576/Crooks) B1IPK1 B1IPK1 ECOLC
MNFPLIANIVVFVVLLFALAQ

SEQ ID NO: 653 - protein, 21 aa, Escherichia coli
  misc feature (1)..(21): Escherichia coli P62532 PAPK ECOLX
MIKSTGALLLFAALSAGQAIA

SEQ ID NO: 654 - protein, 21 aa, Escherichia coli
  misc feature (1)..(21): Escherichia coli P62607 FMF2 ECOLX
MIKSVIAGAVAMAVVSFGAYA

SEQ ID NO: 655 - protein, 21 aa, Escherichia coli
  misc feature (1)..(21): Escherichia coli (strain K12) P75885 GFCA ECOLI
MKHKLSAILMAFMLTTPAAFA

SEQ ID NO: 656 - protein, 21 aa, Escherichia coli
  misc feature (1)..(21): Escherichia coli (strain K12) P0A912 PAL ECOLI
MQLNKVLKGLMIALPVMAIAA

SEQ ID NO: 657 - protein, 21 aa, Escherichia coli
  misc feature (1)..(21): Escherichia coli (strain ATCC 8739/DSM 1576/Crooks) B1IQX6 B1IQX6 ECOLC
MKRAPLITGLLLISTSCAYAS

SEQ ID NO: 658 - protein, 21 aa, Escherichia coli
  misc feature (1)..(21): Escherichia coli (strain K12) P0A855 TOLB ECOLI
MKQALRVAFGFLILWASVLHA

SEQ ID NO: 659 - protein, 21 aa, Escherichia coli
  misc feature (1)..(21): Escherichia coli O157:H7 P0AF84 YJFN ECO57
MKQLLASPSLQLVTYPASATA

SEQ ID NO: 660 - protein, 21 aa, Escherichia coli
  misc feature (1)..(21): Escherichia coli (strain K12) P76520 YFDX ECOLI
MKRLIMATMVTAILASSTVWA

SEQ ID NO: 661 - protein, 21 aa, Escherichia coli
  misc feature (1)..(21): Escherichia coli (strain ATCC 8739/DSM 1576/Crooks) B1IW84 B1IW84 ECOLC
MRTLQGWLLPVFMLPMAVYAQ

SEQ ID NO: 662 - protein, 21 aa, Escherichia coli
  misc feature (1)..(21): Escherichia coli (strain K12) P76172 YNFD ECOLI
MKLSTCCAALLLALASPAVLA

SEQ ID NO: 663 - protein, 21 aa, Escherichia coli
  misc feature (1)..(21): Escherichia coli Q99PX3 Q99PX3 ECOLX
MHKYQILMISFFVLCAETFAE

SEQ ID NO: 664 - protein, 21 aa, Escherichia coli
  misc feature (1)..(21): Escherichia coli O157:H7 P61318 LOLA ECO57
MKKIAITCALLSSLVASSVWA

SEQ ID NO: 665 - protein, 21 aa, Escherichia coli
  misc feature (1)..(21): Escherichia coli P53511 CSSB2 ECOLX
MLKKIISAIALIAGTSGVVNA

SEQ ID NO: 666 - protein, 21 aa, Escherichia coli
  misc feature (1)..(21): Escherichia coli (strain K12) P77214 CUSF ECOLI
MKKALQVAMFSLFTVIGFNAQ

SEQ ID NO: 667 - protein, 21 aa, Escherichia coli
  misc feature (1)..(21): Escherichia coli (strain ATCC 8739/DSM 1576/Crooks) B1IV59 B1IV59 ECOLC
MKLLKVAAIAAIVFSGSALAG

SEQ ID NO: 668 - protein, 21 aa, Escherichia coli
  misc feature (1)..(21): Escherichia coli (strain K12) P33219 YEBF ECOLI
MKKRGAFLGLLLVSACASVFA

SEQ ID NO: 669 - protein, 21 aa, Escherichia coli
  misc feature (1)..(21): Escherichia coli (strain K12) P42591 YGJJ ECOLI
MKLITAPCRALLALPFCYAFS

SEQ ID NO: 670 - protein, 21 aa, Escherichia coli
  misc feature (1)..(21): Escherichia coli O157:H7 P61321 LOLB ECO57
MPLPDFRLIRLLPLAALVLTA

SEQ ID NO: 671 - protein, 21 aa, Escherichia coli
  misc feature (1)..(21): Escherichia coli (strain K12) P0ADV7 YRBC ECOLI
MFKRLMMVALLVIAPLSAATA

SEQ ID NO: 672 - protein, 21 aa, Escherichia coli
  misc feature (1)..(21): Escherichia coli (strain ATCC 8739/DSM 1576/Crooks) B1IUM4 B1IUM4 ECOLC
MIKQTFVALLLSVGASSVFAA

SEQ ID NO: 673 - protein, 21 aa, Escherichia coli
  misc feature (1)..(21): Escherichia coli O157:H7 Q8XBY2 CUSF ECO57
MKKALQVAMFSLFTVIGFNAQ

SEQ ID NO: 674 - protein, 21 aa, Escherichia coli
  misc feature (1)..(21): Escherichia coli (strain K12) P0AAU2 YBFA ECOLI
MELYREYPAWLIFLRRTYAVA

SEQ ID NO: 675 - protein, 21 aa, Escherichia coli
  misc feature (1)..(21): Escherichia coli Q47105 Q47105 ECOLX
MKKTLIALAVAVSAVSGAAHA

SEQ ID NO: 676 - protein, 21 aa, Escherichia coli
  misc feature (1)..(21): Escherichia coli (strain K12) P0AES9 HDEA ECOLI
MKKVLGVILGGLLLLPVVSNA

SEQ ID NO: 677 - protein, 21 aa, Escherichia coli
  misc feature (1)..(21): Escherichia coli O157:H7 P64543 YPEC ECO57
MFRSLFLAAALMAFTPLAANA

SEQ ID NO: 678 - protein, 21 aa, Escherichia coli
  misc feature (1)..(21): Escherichia coli (strain K12) P45420 YHCD ECOLI
MLKKTLLAYTIGFAFSPPANA

SEQ ID NO: 679 - protein, 21 aa, Escherichia coli
  misc feature (1)..(21): Escherichia coli (strain ATCC 8739/DSM 1576/Crooks) B1IQG3 B1IQG3 ECOLC
MKKWLLAAGLGLALATSAQAA

SEQ ID NO: 680 - protein, 21 aa, Escherichia coli
  misc feature (1)..(21): Escherichia coli O08337 BLA8 ECOLX
MRYIRLCIISLLATLPLAVHA

SEQ ID NO: 681 - protein, 21 aa, Escherichia coli
  misc feature (1)..(21): Escherichia coli O157:H7 P0AET0 HDEA ECO57
MKKVLGVILGGLLLLPVVSNA

SEQ ID NO: 682 - protein, 21 aa, Escherichia coli
  misc feature (1)..(21): Escherichia coli (strain K12) P13979 TRAT1 ECOLI
MMKTKKLMMVALVSSTLALSG

SEQ ID NO: 683 - protein, 21 aa, Escherichia coli
  misc feature (1)..(21): Escherichia coli (strain K12) P36560 ASR ECOLI
MKKVLALVVAAAMGLSSAAFA

SEQ ID NO: 684 - protein, 21 aa, Escherichia coli
  misc feature (1)..(21): Escherichia coli (strain K12) P08191 FIMH ECOLI
MKRVITLFAVLLMGWSVNAWS

SEQ ID NO: 685 - protein, 21 aa, Escherichia coli
  misc feature (1)..(21): Escherichia coli O6 P62608 FMF2 ECOL6
MIKSVIAGAVAMAVVSFGAYA

SEQ ID NO: 686 - protein, 21 aa, Escherichia coli
  misc feature (1)..(21): Escherichia coli (strain ATCC 8739/DSM 1576/Crooks) B1IWQ5 B1IWQ5 ECOLC
MRRVFWLVAAALLLAGCAGEK

SEQ ID NO: 687 - protein, 21 aa, Escherichia coli
  misc feature (1)..(21): Escherichia coli (strain ATCC 8739/DSM 1576/Crooks) B1IZZ9 B1IZZ9 ECOLC
MKHQWMTAIFCLVCPLSSMAA

SEQ ID NO: 688 - protein, 21 aa, Escherichia coli
  misc feature (1)..(21): Escherichia coli (strain ATCC 8739/DSM 1576/Crooks) B1J0C0 B1J0C0 ECOLC
MNRRRKLLIPLLFCGAMLTAC

SEQ ID NO: 689 - protein, 21 aa, Escherichia coli
  misc feature (1)..(21): Escherichia coli (strain ATCC 8739/DSM 1576/Crooks) B1J0C7 B1J0C7 ECOLC
MNMTKGALILSLSFLLAACSS

SEQ ID NO: 690 - protein, 21 aa, Escherichia coli
  misc feature (1)..(21): Escherichia coli (strain ATCC 8739/DSM 1576/Crooks) B1IT07 B1IT07 ECOLC
MFSRVLALLAVLLLSANTWAA

SEQ ID NO: 691 - protein, 21 aa, Escherichia coli
  misc feature (1)..(21): Escherichia coli (strain ATCC 8739/DSM 1576/Crooks) B1J105 B1J105 ECOLC
MNPALLATLGTLAETASLKAD

SEQ ID NO: 692 - protein, 21 aa, Escherichia coli
  misc feature (1)..(21): Escherichia coli O111:H- B3Y154 MLTF ECO11
MKKLKINYLFIGILALLLAVA

SEQ ID NO: 693 - protein, 21 aa, Escherichia coli
  misc feature (1)..(21): Escherichia coli Q9K597 Q9K597 ECOLX
MKVKVLSLLVPALLVAGAANA

SEQ ID NO: 694 - protein, 21 aa, Escherichia coli
  misc feature (1)..(21): Escherichia coli P02970 FAEG1 ECOLX
MKKTLIALAIAASAASGMAHA

SEQ ID NO: 695 - protein, 21 aa, Escherichia coli
  misc feature (1)..(21): Escherichia coli (strain ATCC 8739/DSM 1576/Crooks) B1IQZ3 ASR ECOLC
MKKVLALVVAAAMGLSSAAFA

SEQ ID NO: 696 - protein, 21 aa, Escherichia coli
  misc feature (1)..(21): Escherichia coli Q47489 Q47489 ECOLX
MKQSTIALALLPLLFTPVTKA

SEQ ID NO: 697 - protein, 21 aa, Escherichia coli
  misc feature (1)..(21): Escherichia coli (strain K12) P0AC05 FLIP ECOLI
MRRLLSVAPVLLWLITPLAFA

SEQ ID NO: 698 - protein, 21 aa, Escherichia coli
  misc feature (1)..(21): Escherichia coli (strain K12) P76335 YEDS ECOLI
MKRKVLAMLVPALLVAGAANA

SEQ ID NO: 699 - protein, 21 aa, Escherichia coli
  misc feature (1)..(21): Escherichia coli O9:H4 (strain HS) A7ZZE5 LOLB ECOHS
MPLPDFRLIRLLPLAALVLTA

SEQ ID NO: 700 - protein, 21 aa, Escherichia coli
  misc feature (1)..(21): Escherichia coli Q47484 Q47484 ECOLX
MKHSTIALALLPLLFTPVTKA

SEQ ID NO: 701 - protein, 21 aa, Escherichia coli
  misc feature (1)..(21): Escherichia coli O139:H28 (strain E24377A/ETEC) A7ZNP7 MDTA ECO24
MKGSYKSRWVIVIVVVIAAIA

SEQ ID NO: 702 - protein, 21 aa, Escherichia coli
  misc feature (1)..(21): Escherichia coli O6 P61317 LOLA ECOL6
MKKIAITCALLSSLVASSVWA

SEQ ID NO: 703 - protein, 21 aa, Escherichia coli
  misc feature (1)..(21): Escherichia coli O157:H7 P0ADE5 YTFM ECO57
MRYIRQLCCVSLLCLSGSAVA

SEQ ID NO: 704 - protein, 21 aa, Escherichia coli
  misc feature (1)..(21): Escherichia coli (strain K12) Q9JMT5 YUAE ECOLI
MFNRRVLFLSVFSCAVFMLSG

SEQ ID NO: 705 - protein, 21 aa, Escherichia coli
  misc feature (1)..(21): Escherichia coli O157:H7 Q8X783 ASR ECO57
MKKVLALVVAAAMGLSSAAFA

SEQ ID NO: 706 - protein, 21 aa, Escherichia coli
  misc feature (1)..(21): Escherichia coli (strain ATCC 8739/DSM 1576/Crooks) B1IXS9 B1IXS9 ECOLC
MIWLTLVFASLLSVAGQLCQK

SEQ ID NO: 707 - protein, 21 aa, Escherichia coli
  misc feature (1)..(21): Escherichia coli (strain K12) P0ADB7 ECNB ECOLI
MVKKTIAAIFSVLVLSTVLTA

SEQ ID NO: 708 - protein, 21 aa, Escherichia coli
  misc feature (1)..(21): Escherichia coli (strain K12) P75933 FLGA ECOLI
MLIIKRSVAIIAILFSPLSTA

SEQ ID NO: 709 - protein, 21 aa, Escherichia coli
  misc feature (1)..(21): Escherichia coli (strain ATCC 8739/DSM 1576/Crooks) B1J0Y0 B1J0Y0 ECOLC
MKKHLLPLALLFSGISPAQAL

SEQ ID NO: 710 - protein, 21 aa, Escherichia coli
  misc feature (1)..(21): Escherichia coli (strain ATCC 8739/DSM 1576/Crooks) B1IZP2 B1IZP2 ECOLC
MKKRVYLIAAVVSGALAVSGC

SEQ ID NO: 711 - protein, 21 aa, Escherichia coli
  misc feature (1)..(21): Escherichia coli O6 Q8CVX8 MDTA ECOL6
MKGSYKSRWVIVIVVVIAAIA

SEQ ID NO: 712 - protein, 21 aa, Escherichia coli
  misc feature (1)..(21): Escherichia coli (strain DH10B) B1XB33 MLTF ECODH
MKKLKINYLFIGILALLLAVA

SEQ ID NO: 713 - protein, 21 aa, Escherichia coli
  misc feature (1)..(21): Escherichia coli O6 P0AF83 YJFN ECOL6
MKQLLASPSLQLVTYPASATA

SEQ ID NO: 714 - protein, 21 aa, Escherichia coli
  misc feature (1)..(21): Escherichia coli O157:H7 P0A6S1 FLGH ECO57
MQKNAAHTYAISSLLVLSLTG

SEQ ID NO: 715 - protein, 21 aa, Escherichia coli
  misc feature (1)..(21): Escherichia coli Q708G9 Q708G9 ECOLX
MKKTLIALAIAASAASGMAHA

SEQ ID NO: 716 - protein, 21 aa, Escherichia coli
  misc feature (1)..(21): Escherichia coli (strain K12) P46130 YBHC ECOLI
MNTFSVSRLALALAFGVTLTA

SEQ ID NO: 717 - protein, 21 aa, Escherichia coli
  misc feature (1)..(21): Escherichia coli O157:H7 P0ADB9 ECNB ECO57
MVKKTIAAIFSVLVLSTVLTA

SEQ ID NO: 718 - protein, 21 aa, Escherichia coli
  misc feature (1)..(21): Escherichia coli O6 Q8FFV6 MDTQ ECOL6
MNRDSFYPAIACFPLLLMLAG

SEQ ID NO: 719 - protein, 21 aa, Escherichia coli
  misc feature (1)..(21): Escherichia coli O6 Q8CVZ5 YEBF ECOL6
MKKRGAFLGLLLVSACASVFA

SEQ ID NO: 720 - protein, 21 aa, Escherichia coli
  misc feature (1)..(21): Escherichia coli (strain K12) P30855 EVGS ECOLI
MKFLPYIFLLCCGLWSTISFA

SEQ ID NO: 721 - protein, 21 aa, Escherichia coli
  misc feature (1)..(21): Escherichia coli (strain K12) P06996 OMPC ECOLI
MKVKVLSLLVPALLVAGAANA

SEQ ID NO: 722 - protein, 21 aa, Escherichia coli
  misc feature (1)..(21): Escherichia coli P0AD63 BLA1 ECOLX
MRYIRLCIISLLATLPLAVHA

SEQ ID NO: 723 - protein, 21 aa, Escherichia coli
  misc feature (1)..(21): Escherichia coli O6 Q8CW45 LOLB ECOL6
MPLPDFRFIRLLPLAALVLTA

SEQ ID NO: 724 - protein, 21 aa, Escherichia coli
  misc feature (1)..(21): Escherichia coli O139:H28 (strain E24377A/ETEC) A7ZJC2 TOLB ECO24
MKQALRVAFGFLILWASVLHA

SEQ ID NO: 725 - protein, 21 aa, Escherichia coli
  misc feature (1)..(21): Escherichia coli (strain ATCC 8739/DSM 1576/Crooks) B1IPH6 B1IPH6 ECOLC
MRHCGWLLGLLSLFSLATHAS

SEQ ID NO: 726 - protein, 21 aa, Escherichia coli
  misc feature (1)..(21): Escherichia coli Q57228 Q57228 ECOLX
MQKIQFILGILAAASSSATLA

SEQ ID NO: 727 - protein, 21 aa, Escherichia coli
  misc feature (1)..(21): Escherichia coli O157:H7 Q8XCK0 YEBF ECO57
MKKRGAFLGLLLVSACASVFA

SEQ ID NO: 728 - protein, 21 aa, Escherichia coli
  misc feature (1)..(21): Escherichia coli O157:H7 P0AB32 YCEK ECO57
MRLIVVSIMVTLLSGCGSIIS

SEQ ID NO: 729 - protein, 21 aa, Escherichia coli
  misc feature (1)..(21): Escherichia coli Q93LM8 BLA34 ECOLX
MRYFRLCIISLLATLPLAVHA

SEQ ID NO: 730 - protein, 21 aa, Escherichia coli
  misc feature (1)..(21): Escherichia coli P0A9Z7 BLA2 ECOLX
MRYIRLCIISLLATLPLAVHA

SEQ ID NO: 731 - protein, 21 aa, Escherichia coli
  misc feature (1)..(21): Escherichia coli (strain K12) P39176 ERFK ECOLI
MRRVNILCSFALLFASHTSLA

SEQ ID NO: 732 - protein, 21 aa, Escherichia coli
  misc feature (1)..(21): Escherichia coli (strain K12) P0ADE4 YTFM ECOLI
MRYIRQLCCVSLLCLSGSAVA

SEQ ID NO: 733 - protein, 21 aa, Escherichia coli
  misc feature (1)..(21): Escherichia coli O9:H4 (strain HS) A7ZZ37 FLGH ECOHS
MQKNAAHTYAISSLLVLSLTG

SEQ ID NO: 734 - protein, 21 aa, Escherichia coli
  misc feature (1)..(21): Escherichia coli O157:H7 P0ABK8 CSGB ECO57
MKNKLLFMMLTILGAPGIAAA

SEQ ID NO: 735 - protein, 21 aa, Escherichia coli
  misc feature (1)..(21): Escherichia coli O9:H4 (strain HS) A7ZYJ5 LOLA ECOHS
MKKIAITCALLSSLVASSVWA

SEQ ID NO: 736 - protein, 21 aa, Escherichia coli
  misc feature (1)..(21): Escherichia coli (strain ATCC 8739/DSM 1576/Crooks) B1IPR3 B1IPR3 ECOLC
MNILITTTAFTALFCGAAFAQ

SEQ ID NO: 737 - protein, 21 aa, Escherichia coli
  misc feature (1)..(21): Escherichia coli (strain K12) P33369 MDTQ ECOLI
MNRDSFYPAIACFPLLLMLAG

SEQ ID NO: 738 - protein, 21 aa, Escherichia coli
  misc feature (1)..(21): Escherichia coli (strain K12) P0AFM2 PROX ECOLI
MRHSVLFATAFATLISTQTFA

SEQ ID NO: 739 - protein, 21 aa, Escherichia coli
  misc feature (1)..(21): Escherichia coli (strain K12) P02932 PHOE ECOLI
MKKSTLALVVMGIVASASVQA

SEQ ID NO: 740 - protein, 21 aa, Escherichia coli
  misc feature (1)..(21): Escherichia coli (strain K12) P18473 TRBC ECOLI
MKLSMKSLAALLMMLNGAVMA

SEQ ID NO: 741 - protein, 21 aa, Escherichia coli
  misc feature (1)..(21): Escherichia coli P71217 P71217 ECOLX
MIKSVIAGAVAMAVVSFGVNA

SEQ ID NO: 742 - protein, 21 aa, Escherichia coli
  misc feature (1)..(21): Escherichia coli Q47201 Q47201 ECOLX
MRKIQFILGILAAASSSATLA

SEQ ID NO: 743 - protein, 21 aa, Escherichia coli
  misc feature (1)..(21): Escherichia coli O6 P0A856 TOLB ECOL6
MKQALRVAFGFLILWASVLHA

SEQ ID NO: 744 - protein, 21 aa, Escherichia coli
  misc feature (1)..(21): Escherichia coli O6 Q8CVW1 OMPC ECOL6
MKVKVLSLLVPALLVAGAANA

SEQ ID NO: 745 - protein, 21 aa, Escherichia coli
  misc feature (1)..(21): Escherichia coli P24093 DRAA ECOLX
MKKLAIMAAASMVFAVSSAHA

SEQ ID NO: 746 - protein, 21 aa, Escherichia coli
  misc feature (1)..(21): Escherichia coli P13811 ELBH ECOLX
MNKVKFYVLFTALLSSLCAHG

SEQ ID NO: 747 - protein, 21 aa, Escherichia coli
  misc feature (1)..(21): Escherichia coli (strain ATCC 8739/DSM 1576/Crooks) B1ISY5 B1ISY5 ECOLC
MTLRKILALTCLLLPMMASAH

SEQ ID NO: 748 - protein, 21 aa, Escherichia coli
  misc feature (1)..(21): Escherichia coli (strain ATCC 8739/DSM 1576/Crooks) B1IYD6 B1IYD6 ECOLC
MKWLCSVGIAVSLALQPALAD

SEQ ID NO: 749 - protein, 21 aa, Escherichia coli
  misc feature (1)..(21): Escherichia coli (strain ATCC 8739/DSM 1576/Crooks) B1IS12 B1IS12 ECOLC
MNQSLTLAFLIAAGIGLVVQN

SEQ ID NO: 750 - protein, 21 aa, Escherichia coli
  misc feature (1)..(21): Escherichia coli P46005 AGGC ECOLX
MKTSSFIIVILLCFRIENVIA

SEQ ID NO: 751 - protein, 21 aa, Escherichia coli
  misc feature (1)..(21): Escherichia coli (strain K12) P77747 OMPN ECOLI
MKSKVLALLIPALLAAGAAHA

SEQ ID NO: 752 - protein, 21 aa, Escherichia coli
  misc feature (1)..(21): Escherichia coli (strain ATCC 8739/DSM 1576/Crooks) B1IU84 LOLB ECOLC
MPLPDFRLIRLLPLAALVLTA

SEQ ID NO: 753 - protein, 21 aa, Escherichia coli
  misc feature (1)..(21): Escherichia coli (strain UTI89/UPEC) Q1REI5 TOLB ECOUT
MKQALRVAFGFLILWASVLHA

SEQ ID NO: 754 - protein, 21 aa, Escherichia coli
  misc feature (1)..(21): Escherichia coli O139:H28 (strain E24377A/ETEC) A7ZQ01 MLTF ECO24
MKKLKINYLFIGILALLLAVA

SEQ ID NO: 755 - protein, 21 aa, Escherichia coli
  misc feature (1)..(21): Escherichia coli (strain K12) P0A915 OMPW ECOLI
MKKLTVAALAVTTLLSGSAFA

SEQ ID NO: 756 - protein, 21 aa, Escherichia coli
  misc feature (1)..(21): Escherichia coli Q47485 Q47485 ECOLX
MKQSTIALALLPLLFTPVTKA

SEQ ID NO: 757 - protein, 21 aa, Escherichia coli
  misc feature (1)..(21): Escherichia coli (strain K12) P39370 YJHS ECOLI
MNAIISPDYYYVLTVAGQSNA

SEQ ID NO: 758 - protein, 21 aa, Escherichia coli
  misc feature (1)..(21): Escherichia coli (strain K12) P77519 YDDL ECOLI
MKLKIVAVVVTGLLAANVAHA

SEQ ID NO: 759 - protein, 21 aa, Escherichia coli
  misc feature (1)..(21): Escherichia coli O9:H4 (strain HS) A8A366 MLTF ECOHS
MKKLKINYLFIGILALLLAVA

SEQ ID NO: 760 - protein, 21 aa, Escherichia coli
  misc feature (1)..(21): Escherichia coli (strain ATCC 8739/DSM 1576/Crooks) B1IUM5 B1IUM5 ECOLC
MKRPALILICLLLQACSATTK

SEQ ID NO: 761 - protein, 21 aa, Escherichia coli
  misc feature (1)..(21): Escherichia coli P53510 CSSB1 ECOLX
MLKKIIPAIVLIAGTSGVVNA

SEQ ID NO: 762 - protein, 21 aa, Escherichia coli
  misc feature (1)..(21): Escherichia coli O6 Q8CWA3 CUSF ECOL6
MKKALQVAMFSLFTVIGFNAQ

SEQ ID NO: 763 - protein, 21 aa, Escherichia coli
  misc feature (1)..(21): Escherichia coli Q2PQI6 Q2PQI6 ECOLX
MKKTLIALAIAASAASGMAHA

SEQ ID NO: 764 - protein, 21 aa, Escherichia coli
  misc feature (1)..(21): Escherichia coli O157:H7 P0A913 PAL ECO57
MQLNKVLKGLMIALPVMAIAA

SEQ ID NO: 765 - protein, 21 aa, Escherichia coli
  misc feature (1)..(21): Escherichia coli (strain ATCC 8739/DSM 1576/Crooks) B1IZ64 B1IZ64 ECOLC
MRKFIFVLLTLLLVSPFSFAM

SEQ ID NO: 766 - protein, 21 aa, Escherichia coli
  misc feature (1)..(21): Escherichia coli P11312 FMF3 ECOLX
MQKIQFILGILAAASSSATLA

SEQ ID NO: 767 - protein, 21 aa, Escherichia coli
  misc feature (1)..(21): Escherichia coli (strain ATCC 8739/DSM 1576/Crooks) B1IQT9 B1IQT9 ECOLC
MKQQAGIGILLALTTAICWGA

SEQ ID NO: 768 - protein, 21 aa, Escherichia coli
  misc feature (1)..(21): Escherichia coli (strain K12) P75855 YCBQ ECOLI
MKKSVLTAFITVVCATSSVMA

SEQ ID NO: 769 - protein, 21 aa, Escherichia coli
  misc feature (1)..(21): Escherichia coli (strain ATCC 8739/DSM 1576/Crooks) B1IZ67 B1IZ67 ECOLC
MRRVLFSCFCGLLWSSSGWAA

SEQ ID NO: 770 - protein, 21 aa, Escherichia coli
  misc feature (1)..(21): Escherichia coli (strain K12) P76559 YPFG ECOLI
MRYRIFLLFFFALLPTSLVWA

SEQ ID NO: 771 - protein, 21 aa, Escherichia coli
  misc feature (1)..(21): Escherichia coli O6:K15:H31 (strain 536/UPEC) Q0TET0 MLTF ECOL5
MKKLKINYLFIGILALLLAVA

SEQ ID NO: 772 - protein, 21 aa, Escherichia coli
  misc feature (1)..(21): Escherichia coli P46000 FASD ECOLX
MNKYPPLLTMLIIGIGSNAVA

SEQ ID NO: 773 - protein, 21 aa, Escherichia coli
  misc feature (1)..(21): Escherichia coli O157:H7 P0AAU3 YBFA ECO57
MELYREYPAWLIFLRRTYAVA

SEQ ID NO: 774 - protein, 21 aa, Escherichia coli
  misc feature (1)..(21): Escherichia coli (strain UTI89/UPEC) Q1R8H6 MLTF ECOUT
MKKLKINYLFIGILALLLAVA

SEQ ID NO: 775 - protein, 21 aa, Escherichia coli
  misc feature (1)..(21): Escherichia coli Q6PZN4 Q6PZN4 ECOLX
MKRLVFISFVALSMTAGSAMA

SEQ ID NO: 776 - protein, 21 aa, Escherichia coli
  misc feature (1)..(21): Escherichia coli Q9ALL3 Q9ALL3 ECOLX
MIMKKILIASIILTSISASAK

SEQ ID NO: 777 - protein, 21 aa, Escherichia coli
  misc feature (1)..(21): Escherichia coli P14190 FAEG2 ECOLX
MKKTLIALAIAASAASGMAHA

SEQ ID NO: 778 - protein, 21 aa, Escherichia coli
  misc feature (1)..(21): Escherichia coli (strain ATCC 8739/DSM 1576/Crooks) B1IXD0 B1IXD0 ECOLC
MHRQSFFLVPLICLSSALWAA

SEQ ID NO: 779 - protein, 21 aa, Escherichia coli
  misc feature (1)..(21): Escherichia coli O6:K15:H31 (strain 536/UPEC) Q0TIG1 LOLB ECOL5
MPLPDFRFIRLLPLAALVLTA

SEQ ID NO: 780 - protein, 21 aa, Escherichia coli
  misc feature (1)..(21): Escherichia coli O157:H7 Q8X7J5 MDTA ECO57
MKGSYKSRWVIVIVVVIAAIA

SEQ ID NO: 781 - protein, 22 aa, Escherichia coli
  misc feature (1)..(22): Escherichia coli (strain ATCC 8739/DSM 1576/Crooks) B1IVU6 B1IVU6 ECOLC
MKHKLSAILMAFMLTTPAAFAA

SEQ ID NO: 782 - protein, 22 aa, Escherichia coli
  misc feature (1)..(22): Escherichia coli (strain ATCC 8739/DSM 1576/Crooks) B1IPS1 B1IPS1 ECOLC
MFKLKLLSISTIFILAGCVSLA

SEQ ID NO: 783 - protein, 22 aa, Escherichia coli
  misc feature (1)..(22): Escherichia coli Q46945 Q46945 ECOLX
MKKTIMSLAVVSALVSGVAFAA

SEQ ID NO: 784 - protein, 22 aa, Escherichia coli
  misc feature (1)..(22): Escherichia coli (strain ATCC 8739/DSM 1576/Crooks) B1IT81 B1IT81 ECOLC
MKFKVIALAALMGISGMAAQAN

SEQ ID NO: 785 - protein, 22 aa, Escherichia coli
  misc feature (1)..(22): Escherichia coli P04127 PAPA ECOLX
MIKSVIAGAVAMAVVSFGVNNA

SEQ ID NO: 786 - protein, 22 aa, Escherichia coli
  misc feature (1)..(22): Escherichia coli (strain K12) P0ABW5 SFMA ECOLI
MKLRFISSALAAALFAATGSYA

SEQ ID NO: 787 - protein, 22 aa, Escherichia coli
  misc feature (1)..(22): Escherichia coli O6 P64615 YHCN ECOL6
MKIKTTVAALSVLSVLSFGAFA

SEQ ID NO: 788 - protein, 22 aa, Escherichia coli
  misc feature (1)..(22): Escherichia coli (strain K12) P18035 TRBB ECOLI
MSLTKSLLFTLLLSAAAVQAST

SEQ ID NO: 789 - protein, 22 aa, Escherichia coli
  misc feature (1)..(22): Escherichia coli (strain K12) P0AF70 YJEI ECOLI
MHVKYLAGIVGAALLMAGCSSS

SEQ ID NO: 790 - protein, 22 aa, Escherichia coli
  misc feature (1)..(22): Escherichia coli (strain ATCC 8739/DSM 1576/Crooks) B1ISY1 B1ISY1 ECOLC
MRYIRQLCCVSLLCLSGSAVAA

SEQ ID NO: 791 - protein, 22 aa, Escherichia coli
  misc feature (1)..(22): Escherichia coli (strain K12) P0AAY4 YBJH ECOLI
MIMKNCLLLGALLMGFTGVAMA

SEQ ID NO: 792 - protein, 22 aa, Escherichia coli
  misc feature (1)..(22): Escherichia coli (strain ATCC 8739/DSM 1576/Crooks) B1IYX4 B1IYX4 ECOLC
MTIKNKMLLGALLLVTSAAWAA

SEQ ID NO: 793 - protein, 22 aa, Escherichia coli
  misc feature (1)..(22): Escherichia coli (strain ATCC 8739/DSM 1576/Crooks) B1ITP9 B1ITP9 ECOLC
MVKKTIAAIFSVLVLSTVLTAC

SEQ ID NO: 794 - protein, 22 aa, Escherichia coli
  misc feature (1)..(22): Escherichia coli (strain ATCC 8739/DSM 1576/Crooks) B1ITJ9 B1ITJ9 ECOLC
MKKLTVAALAVTTLLSGSAFAH

SEQ ID NO: 795 - protein, 22 aa, Escherichia coli
  misc feature (1)..(22): Escherichia coli (strain ATCC 8739/DSM 1576/Crooks) B1IQT1 B1IQT1 ECOLC
MFKRLMMVALLVIAPLSAATAA

SEQ ID NO: 796 - protein, 22 aa, Escherichia coli
  misc feature (1)..(22): Escherichia coli (strain K12) P25736 END1 ECOLI
MYRYLSIAAVVLSAAFSGPALA

SEQ ID NO: 797 - protein, 22 aa, Escherichia coli
  misc feature (1)..(22): Escherichia coli P25447 FAEF ECOLX
MKKTMMAAALVLSALSIQSALA

SEQ ID NO: 798 - protein, 22 aa, Escherichia coli
  misc feature (1)..(22): Escherichia coli O6 P0AA92 YEAY ECOL6
MAVQKNVIKGILAGTFALMLSG

SEQ ID NO: 799 - protein, 22 aa, Escherichia coli
  misc feature (1)..(22): Escherichia coli (strain ATCC 8739/DSM 1576/Crooks) B1ITF9 B1ITF9 ECOLC
MRQVLSSLLVIAGLVSGQAIAA

SEQ ID NO: 800 - protein, 22 aa, Escherichia coli
  misc feature (1)..(22): Escherichia coli Q47232 Q47232 ECOLX
MKMTRLYPLALGGLLLPAIANA

SEQ ID NO: 801 - protein, 22 aa, Escherichia coli
  misc feature (1)..(22): Escherichia coli P11900 FMF4 ECOLX
MKKTLIALAVAASAAVSGSVMA

SEQ ID NO: 802 - protein, 22 aa, Escherichia coli
  misc feature (1)..(22): Escherichia coli (strain K12) P75883 GFCC ECOLI
MNKLQSYFIASVLYVMTPHAFA

SEQ ID NO: 803 - protein, 22 aa, Escherichia coli
  misc feature (1)..(22): Escherichia coli (strain ATCC 8739/DSM 1576/Crooks) B1IT51 B1IT51 ECOLC
MKKQWIVGTALLMLMTGNAWAD

SEQ ID NO: 804 - protein, 22 aa, Escherichia coli
  misc feature (1)..(22): Escherichia coli O6 P67555 OPGG ECOL6
MMKMRWLSAAVMLTLYTSSSWA

SEQ ID NO: 805 - protein, 22 aa, Escherichia coli
  misc feature (1)..(22): Escherichia coli (strain ATCC 8739/DSM 1576/Crooks) B1IUG1 B1IUG1 ECOLC
MRKGCFGLVSLALLLLVGCRSH

SEQ ID NO: 806 - protein, 22 aa, Escherichia coli
  misc feature (1)..(22): Escherichia coli O157:H7 P0ABE8 C562 ECO57
MRKSLLAILAVSSLVFSSASFA

SEQ ID NO: 807 - protein, 22 aa, Escherichia coli
  misc feature (1)..(22): Escherichia coli (strain ATCC 8739/DSM 1576/Crooks) B1IV30 B1IV30 ECOLC
MLAIKRSVAIIAILFSPLSAAS

SEQ ID NO: 808 - protein, 22 aa, Escherichia coli
  misc feature (1)..(22): Escherichia coli P07111 PAPH ECOLX
MRLRFSVPLFFFGCVFVHGVFA

SEQ ID NO: 809 - protein, 22 aa, Escherichia coli
  misc feature (1)..(22): Escherichia coli (strain ATCC 8739/DSM 1576/Crooks) B1ISU1 B1ISU1 ECOLC
MKKLLPCTALVMCAGMACAQAE

SEQ ID NO: 810 - protein, 22 aa, Escherichia coli
  misc feature (1)..(22): Escherichia coli (strain K12) P19926 AGP ECOLI
MNKTLIAAAVAGIVLLASNAQA

SEQ ID NO: 811 - protein, 22 aa, Escherichia coli
  misc feature (1)..(22): Escherichia coli O157:H7 P0AE97 CSGE ECO57
MKRYLRWIVAAEFLFAAGNLHA

SEQ ID NO: 812 - protein, 22 aa, Escherichia coli
  misc feature (1)..(22): Escherichia coli (strain ATCC 8739/DSM 1576/Crooks) B1IVZ3 B1IVZ3 ECOLC
MKKSVLTAFITVVCATSSVMAA

SEQ ID NO: 813 - protein, 22 aa, Escherichia coli
  misc feature (1)..(22): Escherichia coli (strain ATCC 8739/DSM 1576/Crooks) B1IR04 B1IR04 ECOLC
MKLSTCCAALLLALASPAVLAA

SEQ ID NO: 814 - protein, 22 aa, Escherichia coli
  misc feature (1)..(22): Escherichia coli (strain K12) Q47537 TAUA ECOLI
MAISSRNTLLAALAFIAFQAQA

SEQ ID NO: 815 - protein, 22 aa, Escherichia coli
  misc feature (1)..(22): Escherichia coli (strain ATCC 8739/DSM 1576/Crooks) B1J037 B1J037 ECOLC
MNTNVFRLLLLGSLFSLSACVQ

SEQ ID NO: 816 - protein, 22 aa, Escherichia coli
  misc feature (1)..(22): Escherichia coli (strain ATCC 8739/DSM 1576/Crooks) B1J116 B1J116 ECOLC
MKNYLWLVALLPLLSGCESQAI

SEQ ID NO: 817 - protein, 22 aa, Escherichia coli
  misc feature (1)..(22): Escherichia coli (strain ATCC 8739/DSM 1576/Crooks) B1IV60 B1IV60 ECOLC
MKNKLLFMMLTILGAPGIAAAA

SEQ ID NO: 818 - protein, 22 aa, Escherichia coli
  misc feature (1)..(22): Escherichia coli Q46680 Q46680 ECOLX
MNKVIAVSALAMAGMFSTQALA

SEQ ID NO: 819 - protein, 22 aa, Escherichia coli
  misc feature (1)..(22): Escherichia coli O6 P0AEQ4 GLNH ECOL6
MKSVLKVSLAALTLAFAVSSHA

SEQ ID NO: 820 - protein, 22 aa, Escherichia coli
  misc feature (1)..(22): Escherichia coli O6 P0AEU1 HISJ ECOL6
MKKLVLSLSLVLAFSSATAAFA

SEQ ID NO: 821 - protein, 22 aa, Escherichia coli
  misc feature (1)..(22): Escherichia coli (strain K12) P76063 YDAS ECOLI
MKKENYSFKQACAVVGGQSAMA

SEQ ID NO: 822 - protein, 22 aa, Escherichia coli
  misc feature (1)..(22): Escherichia coli O111:NM Q1ELY1 Q1ELY1 ECOLX
MKIIIFRVLTFFFVIFSVNVVA

SEQ ID NO: 823 - protein, 22 aa, Escherichia coli
  misc feature (1)..(22): Escherichia coli (strain ATCC 8739/DSM 1576/Crooks) B1IRM3 B1IRM3 ECOLC
MRNRLIAAILGLCGAVTGVQAA

SEQ ID NO: 824 - protein, 22 aa, Escherichia coli
  misc feature (1)..(22): Escherichia coli O6 Q8CW58 YCEI ECOL6
MKKSLLGLTFASLMFSAGSAVA

SEQ ID NO: 825 - protein, 22 aa, Escherichia coli
  misc feature (1)..(22): Escherichia coli (strain K12) P76158 YDFP ECOLI
MNQIFMVIFLVLSGFIVGNVWS

SEQ ID NO: 826 - protein, 22 aa, Escherichia coli
  misc feature (1)..(22): Escherichia coli (strain K12) P77348 MPPA ECOLI
MKHSVSVTCCALLVSSISLSYA

SEQ ID NO: 827 - protein, 22 aa, Escherichia coli
  misc feature (1)..(22): Escherichia coli (strain ATCC 8739/DSM 1576/Crooks) B1IP88 B1IP88 ECOLC
MDLYIQIIVVACLTGMTSLLAH

SEQ ID NO: 828 - protein, 22 aa, Escherichia coli
  misc feature (1)..(22): Escherichia coli (strain ATCC 8739/DSM 1576/Crooks) B1IUM6 B1IUM6 ECOLC
MKKVLYGIFAISALAATSAWAA

SEQ ID NO: 829 - protein, 22 aa, Escherichia coli
  misc feature (1)..(22): Escherichia coli (strain K12) P76002 YCGK ECOLI
MKIKSIRKAVLLLALLTSTSFA

SEQ ID NO: 830 - protein, 22 aa, Escherichia coli
  misc feature (1)..(22): Escherichia coli (strain ATCC 8739/DSM 1576/Crooks) B1J0Z3 B1J0Z3 ECOLC
MKKSTLALVVMGIVASASVQAA

SEQ ID NO: 831 - protein, 22 aa, Escherichia coli
  misc feature (1)..(22): Escherichia coli (strain K12) P18471 TRAU ECOLI
MKRRLWLLMLFLFAGHVPAASA

SEQ ID NO: 832 - protein, 22 aa, Escherichia coli
  misc feature (1)..(22): Escherichia coli Q9RH91 F17FG ECOLX
MTNFYKVFLAVFILVCCNISHA

SEQ ID NO: 833 - protein, 22 aa, Escherichia coli
  misc feature (1)..(22): Escherichia coli (strain K12) P26365 AMIB ECOLI
MMYRIRNWLVATLLLLCTPVGA

SEQ ID NO: 834 - protein, 22 aa, Escherichia coli
  misc feature (1)..(22): Escherichia coli (strain ATCC 8739/DSM 1576/Crooks) B1ISJ8 B1ISJ8 ECOLC
MLAFIRFLFAGLLLVISHAFAA

SEQ ID NO: 835 - protein, 22 aa, Escherichia coli
  misc feature (1)..(22): Escherichia coli O9:H4 (strain HS) A7ZZ05 OPGG ECOHS
MMKMRWLSAAVMLTLYTSSSWA

SEQ ID NO: 836 - protein, 22 aa, Escherichia coli
  misc feature (1)..(22): Escherichia coli (strain ATCC 8739/DSM 1576/Crooks) B1IT68 B1IT68 ECOLC
MKIRALLVAMSVATVLTGCQNM

SEQ ID NO: 837 - protein, 22 aa, Escherichia coli
  misc feature (1)..(22): Escherichia coli Q79EB3 Q79EB3 ECOLX
MKCILFKWVLCLLLGFSSVSYS

SEQ ID NO: 838 - protein, 22 aa, Escherichia coli
  misc feature (1)..(22): Escherichia coli Q47230 Q47230 ECOLX
MKMTRLYPLALGGLLLPAIANA

SEQ ID NO: 839 - protein, 22 aa, Escherichia coli
  misc feature (1)..(22): Escherichia coli (strain K12) P42592 YGJK ECOLI
MKIKTILTPVTCALLISFSAHA

SEQ ID NO: 840 - protein, 22 aa, Escherichia coli
  misc feature (1)..(22): Escherichia coli (strain ATCC 8739/DSM 1576/Crooks) B1IZW1 B1IZW1 ECOLC
MRRLLSVAPVLLWLVTPLAFAQ

SEQ ID NO: 841 - protein, 22 aa, Escherichia coli
  misc feature (1)..(22): Escherichia coli (strain ATCC 8739/DSM 1576/Crooks) B1IUZ4 B1IUZ4 ECOLC
MRHSVLFATAFATLISTQTFAA

SEQ ID NO: 842 - protein, 22 aa, Escherichia coli
  misc feature (1)..(22): Escherichia coli (strain ATCC 8739/DSM 1576/Crooks) B1IYS8 B1IYS8 ECOLC
MKPTTLLLIFTFFAMPGIVYAE

SEQ ID NO: 843 - protein, 22 aa, Escherichia coli
  misc feature (1)..(22): Escherichia coli (strain K12) P77789 YDES ECOLI
MKYNNIIFLGLCLGLTTYSALS

SEQ ID NO: 844 - protein, 22 aa, Escherichia coli
  misc feature (1)..(22): Escherichia coli Q47033 F17CG ECOLX
MTNFYKVFLAVFILVCCNISHA

SEQ ID NO: 845 - protein, 22 aa, Escherichia coli
  misc feature (1)..(22): Escherichia coli (strain K12) P33344 YEHE ECOLI
MNKYWLSGIIFLAYGLASPAFS

SEQ ID NO: 846 - protein, 22 aa, Escherichia coli
  misc feature (1)..(22): Escherichia coli (strain K12) P76537 YFEY ECOLI
MKSLRLMLCAMPLMLTGCSTMS

SEQ ID NO: 847 - protein, 22 aa, Escherichia coli
  misc feature (1)..(22): Escherichia coli O111:NM Q1ELX7 Q1ELX7 ECOLX
MKCILFKWVLCLLLGFSSVSYS

SEQ ID NO: 848 - protein, 22 aa, Escherichia coli
  misc feature (1)..(22): Escherichia coli O6 P0ADT9 YGIM ECOL6
MPKLRLIGLTLLALSATAVSHA

SEQ ID NO: 849 - protein, 22 aa, Escherichia coli
  misc feature (1)..(22): Escherichia coli O6 P0AF71 YJEI ECOL6
MHVKYLAGIVGAALLMAGCSSS

SEQ ID NO: 850 - protein, 22 aa, Escherichia coli
  misc feature (1)..(22): Escherichia coli (strain K12) P33354 YEHR ECOLI
MKAFNKLFSLVVASVLVFSLAG

SEQ ID NO: 851 - protein, 22 aa, Escherichia coli
  misc feature (1)..(22): Escherichia coli (strain ATCC 8739/DSM 1576/Crooks) B1IY57 B1IY57 ECOLC
MKVKVLSLLVPALLVAGAANAA

SEQ ID NO: 852 - protein, 22 aa, Escherichia coli
  misc feature (1)..(22): Escherichia coli (strain K12) P0AE95 CSGE ECOLI
MKRYLRWIVAAEFLFAAGNLHA

SEQ ID NO: 853 - protein, 22 aa, Escherichia coli
  misc feature (1)..(22): Escherichia coli (strain ATCC 8739/DSM 1576/Crooks) B1J0C3 B1J0C3 ECOLC
MKKVLGVILGGLLLLPVVSNAA

SEQ ID NO: 854 - protein, 22 aa, Escherichia coli
  misc feature (1)..(22): Escherichia coli (strain ATCC 8739/DSM 1576/Crooks) B1J0P1 B1J0P1 ECOLC
MKKRGAFLGLLLVSACASVFAA

SEQ ID NO: 855 - protein, 22 aa, Escherichia coli
  misc feature (1)..(22): Escherichia coli O139:H28 (strain E24377A/ETEC) A7ZKF2 OPGG ECO24
MMKMRWLSAAVMLTLYTSSSWA

SEQ ID NO: 856 - protein, 22 aa, Escherichia coli
  misc feature (1)..(22): Escherichia coli (strain ATCC 8739/DSM 1576/Crooks) B1IZQ3 B1IZQ3 ECOLC
MKRRLIIAASLFVFNLSSGFAA

SEQ ID NO: 857 - protein, 22 aa, Escherichia coli
  misc feature (1)..(22): Escherichia coli P25448 FANF ECOLX
MKNKYNLLFFLFLLCYGDVALA

SEQ ID NO: 858 - protein, 22 aa, Escherichia coli
  misc feature (1)..(22): Escherichia coli Q99003 F17AG ECOLX
MTNFYKVFLAVFILVCCNISQA

SEQ ID NO: 859 - protein, 22 aa, Escherichia coli
  misc feature (1)..(22): Escherichia coli (strain ATCC 8739/DSM 1576/Crooks) B1IZK9 B1IZK9 ECOLC
MLINRNIVALFALPFMASATAS

SEQ ID NO: 860 - protein, 22 aa, Escherichia coli
  misc feature (1)..(22): Escherichia coli (strain ATCC 8739/DSM 1576/Crooks) B1IUX8 B1IUX8 ECOLC
MFKRRYVTLLPLFVLLAACSSK

SEQ ID NO: 861 - protein, 22 aa, Escherichia coli
  misc feature (1)..(22): Escherichia coli Q47642 Q47642 ECOLX
MKCILFKWVLCLLLGFSSVSYS

SEQ ID NO: 862 - protein, 22 aa, Escherichia coli
  misc feature (1)..(22): Escherichia coli (strain K12) Q6BEX5 YJDP ECOLI
MKRFPLFLLFTLLTLSTVPAQA

SEQ ID NO: 863 - protein, 22 aa, Escherichia coli
  misc feature (1)..(22): Escherichia coli (strain ATCC 8739/DSM 1576/Crooks) B1ISR5 B1ISR5 ECOLC
MKSKVLALLIPALLAAGAAHAA

SEQ ID NO: 864 - protein, 22 aa, Escherichia coli
  misc feature (1)..(22): Escherichia coli (strain K12) P0AEQ3 GLNH ECOLI
MKSVLKVSLAALTLAFAVSSHA

SEQ ID NO: 865 - protein, 22 aa, Escherichia coli
  misc feature (1)..(22): Escherichia coli O157:H7 P64549 YFIR ECO57
MRFSHRLFLLLILLLTGAPILA

SEQ ID NO: 866 - protein, 22 aa, Escherichia coli
  misc feature (1)..(22): Escherichia coli (strain ATCC 8739/DSM 1576/Crooks) B1IZR0 B1IZR0 ECOLC
MRRVNILCSFALLFASHTSLAV

SEQ ID NO: 867 - protein, 22 aa, Escherichia coli
  misc feature (1)..(22): Escherichia coli (strain ATCC 8739/DSM 1576/Crooks) B1IZU6 B1IZU6 ECOLC
MKRKVLAMLVPALLVAGAANAA

SEQ ID NO: 868 - protein, 22 aa, Escherichia coli
  misc feature (1)..(22): Escherichia coli P42185 PRSH ECOLX
MRLRFSVPLFFFGCVFVHGVFA

SEQ ID NO: 869 - protein, 22 aa, Escherichia coli
  misc feature (1)..(22): Escherichia coli (strain ATCC 8739/DSM 1576/Crooks) B1IQB3 B1IQB3 ECOLC
MIKRVLVVSMVGLSLVGCVNND

SEQ ID NO: 870 - protein, 22 aa, Escherichia coli
  misc feature (1)..(22): Escherichia coli (strain ATCC 8739/DSM 1576/Crooks) B1IS22 B1IS22 ECOLC
MKYKHLILSLSLIMLGPLAHAE

SEQ ID NO: 871 - protein, 22 aa, Escherichia coli
  misc feature (1)..(22): Escherichia coli Q798T6 Q798T6 ECOLX
MKMTRLYPLALGGLLLPAIANA

SEQ ID NO: 872 - protein, 22 aa, Escherichia coli
  misc feature (1)..(22): Escherichia coli (strain ATCC 8739/DSM 1576/Crooks) B1IRS8 B1IRS8 ECOLC
MKPLSSAIAAALILFSAQGVAE

SEQ ID NO: 873 - protein, 22 aa, Escherichia coli
  misc feature (1)..(22): Escherichia coli O111:NM Q1ELX9 Q1ELX9 ECOLX
MKIIIFRVLTFFFVIFSVNVVA

SEQ ID NO: 874 - protein, 22 aa, Escherichia coli
  misc feature (1)..(22): Escherichia coli O6 P0AE96 CSGE ECOL6
MKRYLRWIVAAEFLFAAGNLHA

SEQ ID NO: 875 - protein, 22 aa, Escherichia coli
  misc feature (1)..(22): Escherichia coli (strain K12) P0ADT8 YGIM ECOLI
MPKLRLIGLTLLALSATAVSHA

SEQ ID NO: 876 - protein, 22 aa, Escherichia coli
  misc feature (1)..(22): Escherichia coli (strain K12) P76108 YDCS ECOLI
MSKTFARSSLCALSMTIMTAHA

SEQ ID NO: 877 - protein, 22 aa, Escherichia coli
  misc feature (1)..(22): Escherichia coli O157:H7 P69680 AMTB ECO57
MKIATIKTGLASLAMLPGLVMA

SEQ ID NO: 878 - protein, 22 aa, Escherichia coli
  misc feature (1)..(22): Escherichia coli O157:H7 P0ADU0 YGIM ECO57
MPKLRLIGLTLLALSATAVSHA

SEQ ID NO: 879 - protein, 22 aa, Escherichia coli
  misc feature (1)..(22): Escherichia coli (strain K12) P64548 YFIR ECOLI
MRFSHRLFLLLILLLTGAPILA

SEQ ID NO: 880 - protein, 22 aa, Escherichia coli
  misc feature (1)..(22): Escherichia coli Q9RH92 F17EG ECOLX
MTNFYKVFLAVFILVCCNISHA

SEQ ID NO: 881 - protein, 22 aa, Escherichia coli
  misc feature (1)..(22): Escherichia coli (strain ATCC 8739/DSM 1576/Crooks) B1IRF7 B1IRF7 ECOLC
MKQHKAMIVALIVICITAVVAV

SEQ ID NO: 882 - protein, 22 aa, Escherichia coli
  misc feature (1)..(22): Escherichia coli (strain ATCC 8739/DSM 1576/Crooks) B1J065 B1J065 ECOLC
MKQSTIALALLPLLFTPVTKAR

SEQ ID NO: 883 - protein, 22 aa, Escherichia coli
  misc feature (1)..(22): Escherichia coli (strain K12) P0AB40 YCFR ECOLI
MKNVKTLIAAAILSSMSFASFA

SEQ ID NO: 884 - protein, 22 aa, Escherichia coli
  misc feature (1)..(22): Escherichia coli O157:H7 P0AEQ5 GLNH ECO57
MKSVLKVSLAALTLAFAVSSHA

SEQ ID NO: 885 - protein, 22 aa, Escherichia coli
  misc feature (1)..(22): Escherichia coli O157:H7 P0AEU2 HISJ ECO57
MKKLVLSLSLVLAFSSATAAFA

SEQ ID NO: 886 - protein, 22 aa, Escherichia coli
  misc feature (1)..(22): Escherichia coli (strain K12) P64459 YNCJ ECOLI
MFTKALSVVLLTCALFSGQLMA

SEQ ID NO: 887 - protein, 22 aa, Escherichia coli
  misc feature (1)..(22): Escherichia coli (strain K12) P33136 OPGG ECOLI
MMKMRWLSAAVMLTLYTSSSWA

SEQ ID NO: 888 - protein, 22 aa, Escherichia coli
  misc feature (1)..(22): Escherichia coli Q47200 F17BG ECOLX
MTNFYKVFLAVFILVCCNISHA

SEQ ID NO: 889 - protein, 22 aa, Escherichia coli
  misc feature (1)..(22): Escherichia coli (strain ATCC 8739/DSM 1576/Crooks) B1J064 B1J064 ECOLC
MKITLLVTLLFGLVFLTTVGAA

SEQ ID NO: 890 - protein, 22 aa, Escherichia coli
  misc feature (1)..(22): Escherichia coli O6 Q8CVG7 C562 ECOL6
MRKSLLAILAVSSLVFSSASFA

SEQ ID NO: 891 - protein, 22 aa, Escherichia coli
  misc feature (1)..(22): Escherichia coli (strain K12) P0A927 TSX ECOLI
MKKTLLAAGAVLALSSSFTVNA

SEQ ID NO: 892 - protein, 22 aa, Escherichia coli
  misc feature (1)..(22): Escherichia coli P13980 TRAT3 ECOLX
MKHNVKLMAMTAVLSSVLVLSG

SEQ ID NO: 893 - protein, 22 aa, Escherichia coli
  misc feature (1)..(22): Escherichia coli (strain ATCC 8739/DSM 1576/Crooks) B1IVZ1 B1IVZ1 ECOLC
MSLLRLFFAAVLMLWCAQTAAY

SEQ ID NO: 894 - protein, 22 aa, Escherichia coli
  misc feature (1)..(22): Escherichia coli (strain K12) P76220 YDJY ECOLI
MLQHYSVSWKKGLAALCLLAVA

SEQ ID NO: 895 - protein, 22 aa, Escherichia coli
  misc feature (1)..(22): Escherichia coli (strain K12) P09551 ARGT ECOLI
MKKSILALSLLVGLSTAASSYA

SEQ ID NO: 896 - protein, 22 aa, Escherichia coli
  misc feature (1)..(22): Escherichia coli Q7B2I9 Q7B2I9 ECOLX
MKKNLLITSVLAMATVSGSVLA

SEQ ID NO: 897 - protein, 22 aa, Escherichia coli
  misc feature (1)..(22): Escherichia coli (strain K12) P02931 OMPF ECOLI
MMKRNILAVIVPALLVAGTANA

SEQ ID NO: 898 - protein, 22 aa, Escherichia coli
  misc feature (1)..(22): Escherichia coli (strain ATCC 8739/DSM 1576/Crooks) B1ISQ8 B1ISQ8 ECOLC
MKKTLLLCAFLVGLVSSNVMAL

SEQ ID NO: 899 - protein, 22 aa, Escherichia coli
  misc feature (1)..(22): Escherichia coli O157:H7 P67556 OPGG ECO57
MMKMRWLSAAVMLTLYTSSSWA

SEQ ID NO: 900 - protein, 22 aa, Escherichia coli
  misc feature (1)..(22): Escherichia coli (strain ATCC 8739/DSM 1576/Crooks) B1IYS6 B1IYS6 ECOLC
MIWIMLATLAVVFVVGFRVLTS

SEQ ID NO: 901 - protein, 22 aa, Escherichia coli
  misc feature (1)..(22): Escherichia coli (strain K12) P75687 YKGI ECOLI
MFKKSVLFATLLSGVMAFSTNA

SEQ ID NO: 902 - protein, 22 aa, Escherichia coli
  misc feature (1)..(22): Escherichia coli O6 Q8FAW3 YJDP ECOL6
MKRFPLFLLFTLLTLSTVPAQA

SEQ ID NO: 903 - protein, 22 aa, Escherichia coli
  misc feature (1)..(22): Escherichia coli (strain ATCC 8739/DSM 1576/Crooks) B1IX72 B1IX72 ECOLC
MFRSLFLAAALMAFTPLAANAG

SEQ ID NO: 904 - protein, 22 aa, Escherichia coli
  misc feature (1)..(22): Escherichia coli O6:K15:H31 (strain 536/UPEC) Q0TJ25 OPGG ECOL5
MMKMRWLSAAVMLTLYTSSSWA

SEQ ID NO: 905 - protein, 22 aa, Escherichia coli
  misc feature (1)..(22): Escherichia coli (strain ATCC 8739/DSM 1576/Crooks) B1ISX7 B1ISX7 ECOLC
MWKRLLVVSAVSAAMSSMALAA

SEQ ID NO: 906 - protein, 22 aa, Escherichia coli
  misc feature (1)..(22): Escherichia coli (strain K12) P75917 YMDA ECOLI
MFRPFLNSLMLGSLFFPFIAIA

SEQ ID NO: 907 - protein, 22 aa, Escherichia coli
  misc feature (1)..(22): Escherichia coli (strain ATCC 8739/DSM 1576/Crooks) B1IVI2 B1IVI2 ECOLC
MKRNLLSSAIIVAIMSLGLTGC

SEQ ID NO: 908 - protein, 22 aa, Escherichia coli
  misc feature (1)..(22): Escherichia coli (strain ATCC 8739/DSM 1576/Crooks) B1IU32 B1IU32 ECOLC
MKKTAAIISACMLTFALSACSG

SEQ ID NO: 909 - protein, 22 aa, Escherichia coli
  misc feature (1)..(22): Escherichia coli (strain ATCC 8739/DSM 1576/Crooks) B1IXA0 B1IXA0 ECOLC
MKLRLSALALGTTLLVGCASSG

SEQ ID NO: 910 - protein, 22 aa, Escherichia coli
  misc feature (1)..(22): Escherichia coli (strain K12) P0AAX3 YBIJ ECOLI
MKTINTVVAAMALSTLSFGVFA

SEQ ID NO: 911 - protein, 22 aa, Escherichia coli
  misc feature (1)..(22): Escherichia coli (strain ATCC 8739/DSM 1576/Crooks) B1IVZ5 B1IVZ5 ECOLC
MRNIIKLALAGLLSVSTFAVAA

SEQ ID NO: 912 - protein, 22 aa, Escherichia coli
  misc feature (1)..(22): Escherichia coli O157:H7 P0AAX7 YBIM ECO57
MKKCLTLLIATVLSGISLTAYA

SEQ ID NO: 913 - protein, 22 aa, Escherichia coli
  misc feature (1)..(22): Escherichia coli Q57478 Q57478 ECOLX
MKCILLKWILCLLLGFSSVSYS

SEQ ID NO: 914 - protein, 22 aa, Escherichia coli
  misc feature (1)..(22): Escherichia coli Q47341 F17GG ECOLX
MTNFYKVCLAVFILVCCNISHA

SEQ ID NO: 915 - protein, 22 aa, Escherichia coli
  misc feature (1)..(22): Escherichia coli O6 P0AAX4 YBIJ ECOL6
MKTINTVVAAMALSTLSFGVFA

SEQ ID NO: 916 - protein, 22 aa, Escherichia coli
  misc feature (1)..(22): Escherichia coli (strain ATCC 8739/DSM 1576/Crooks) B1IWE1 B1IWE1 ECOLC
MKKLRVAACMLMLALAGCDNND

SEQ ID NO: 917 - protein, 22 aa, Escherichia coli
  misc feature (1)..(22): Escherichia coli (strain K12) P37028 BTUF ECOLI
MAKSLFRALVALSFLAPLWLNA

SEQ ID NO: 918 - protein, 22 aa, Escherichia coli
  misc feature (1)..(22): Escherichia coli (strain K12) P07102 PPA ECOLI
MKAILIPFLSLLIPLTPQSAFA

SEQ ID NO: 919 - protein, 22 aa, Escherichia coli
  misc feature (1)..(22): Escherichia coli (strain K12) P33341 YEHB ECOLI
MLRMTPLASAIVALLLGIEAYA

SEQ ID NO: 920 - protein, 22 aa, Escherichia coli
  misc feature (1)..(22): Escherichia coli (strain K12) P33590 NIKA ECOLI
MLSTLRRTLFALLACASFIVHA

SEQ ID NO: 921 - protein, 22 aa, Escherichia coli
  misc feature (1)..(22): Escherichia coli O6 Q8CWD2 BTUF ECOL6
MAKSLFRALVALSFLAPLWLNA

SEQ ID NO: 922 - protein, 22 aa, Escherichia coli
  misc feature (1)..(22): Escherichia coli P18103 FANC ECOLX
MKKTLLAIILGGMAFATTNASA

SEQ ID NO: 923 - protein, 22 aa, Escherichia coli
  misc feature (1)..(22): Escherichia coli (strain K12) P02930 TOLC ECOLI
MKKLLPILIGLSLSGFSSLSQA

SEQ ID NO: 924 - protein, 22 aa, Escherichia coli
  misc feature (1)..(22): Escherichia coli Q47199 F17DG ECOLX
MTNFYKVFLAVFILVCCNISQA

SEQ ID NO: 925 - protein, 22 aa, Escherichia coli
  misc feature (1)..(22): Escherichia coli (strain K12) P05825 FEPA ECOLI
MNKKIHSLALLVNLGIYGVAQA

SEQ ID NO: 926 - protein, 22 aa, Escherichia coli
  misc feature (1)..(22): Escherichia coli P15488 FMS3 ECOLX
MLKIKYLLIGLSLSAMSSYSLA

SEQ ID NO: 927 - protein, 22 aa, Escherichia coli
  misc feature (1)..(22): Escherichia coli (strain K12) P64614 YHCN ECOLI
MKIKTTVAALSVLSVLSFGAFA

SEQ ID NO: 928 - protein, 22 aa, Escherichia coli
  misc feature (1)..(22): Escherichia coli (strain ATCC 8739/DSM 1576/Crooks) B1IX92 B1IX92 ECOLC
MKFLPYIFLLCCGLWSTISFAD

SEQ ID NO: 929 - protein, 22 aa, Escherichia coli
  misc feature (1)..(22): Escherichia coli (strain K12) P00805 ASPG2 ECOLI
MEFFKKTALAALVMGFSGAALA

SEQ ID NO: 930 - protein, 22 aa, Escherichia coli
  misc feature (1)..(22): Escherichia coli (strain K12) P23865 PRC ECOLI
MNMFFRLTALAGLLAIAGQTFA

SEQ ID NO: 931 - protein, 22 aa, Escherichia coli
  misc feature (1)..(22): Escherichia coli O6:K15:H31 (strain 536/UPEC) P13430 SFAS ECOL5
MKLKAIILATGLINCIAFSAQA

SEQ ID NO: 932 - protein, 22 aa, Escherichia coli
  misc feature (1)..(22): Escherichia coli Q47645 Q47645 ECOLX
MRHILLKLVLFFCVCLSSASYA

SEQ ID NO: 933 - protein, 22 aa, Escherichia coli
  misc feature (1)..(22): Escherichia coli (strain K12) P0AAA3 MATB ECOLI
MKKKVLAIALVTVFTGMGVAQA

SEQ ID NO: 934 - protein, 22 aa, Escherichia coli
  misc feature (1)..(22): Escherichia coli Q46761 Q46761 ECOLX
MKIKTLAIVVLSALSLSSTAAL

SEQ ID NO: 935 - protein, 22 aa, Escherichia coli
  misc feature (1)..(22): Escherichia coli O6 P0AB41 YCFR ECOL6
MKNVKTLIAAAILSSMSFASFA

SEQ ID NO: 936 - protein, 22 aa, Escherichia coli
  misc feature (1)..(22): Escherichia coli (strain K12) P75737 YBFP ECOLI
MKTNRSLVVIVSLITATLLLTA

SEQ ID NO: 937 - protein, 22 aa, Escherichia coli
  misc feature (1)..(22): Escherichia coli O157:H7 Q8X8V9 METQ ECO57
MAFKFKTFAAVGALIGSLALVG

SEQ ID NO: 938 - protein, 22 aa, Escherichia coli
  misc feature (1)..(22): Escherichia coli (strain ATCC 8739/DSM 1576/Crooks) B1IQZ2 B1IQZ2 ECOLC
MRTTIAVVLGAISLTSAFVFAD

SEQ ID NO: 939 - protein, 22 aa, Escherichia coli
  misc feature (1)..(22): Escherichia coli O157:H7 P64460 YNCJ ECO57
MFTKALSVVLLTCALFSGQLMA

SEQ ID NO: 940 - protein, 22 aa, Escherichia coli
  misc feature (1)..(22): Escherichia coli O157:H7 Q8X3J8 YJDP ECO57
MKRHSTLFLFTLLTLTTVPAQA

SEQ ID NO: 941 - protein, 22 aa, Escherichia coli
  misc feature (1)..(22): Escherichia coli (strain ATCC 8739/DSM 1576/Crooks) B1J072 B1J072 ECOLC
MKRSLLFSAVLCAASLTSVHAA

SEQ ID NO: 942 - protein, 22 aa, Escherichia coli
  misc feature (1)..(22): Escherichia coli (strain K12) P69681 AMTB ECOLI
MKIATIKTGLASLAMLPGLVMA

SEQ ID NO: 943 - protein, 22 aa, Escherichia coli
  misc feature (1)..(22): Escherichia coli (strain ATCC 8739/DSM 1576/Crooks) B1IWJ4 B1IWJ4 ECOLC
MRYRIFLLFFFALLPTSLVWAA

SEQ ID NO: 944 - protein, 22 aa, Escherichia coli
  misc feature (1)..(22): Escherichia coli (strain ATCC 8739/DSM 1576/Crooks) B1J0U9 B1J0U9 ECOLC
MKIISKMLVGALALAVTNVYAA

SEQ ID NO: 945 - protein, 22 aa, Escherichia coli
  misc feature (1)..(22): Escherichia coli O157:H7 P0A8X3 YCEI ECO57
MKKSLLGLTFASLMFSAGSAVA

SEQ ID NO: 946 - protein, 22 aa, Escherichia coli
  misc feature (1)..(22): Escherichia coli Q9AME1 Q9AME1 ECOLX
MKKKVLAIALVTVFTGTGVAQA

SEQ ID NO: 947 - protein, 22 aa, Escherichia coli
  misc feature (1)..(22): Escherichia coli (strain K12) P0AA91 YEAY ECOLI
MAVQKNVIKGILAGTFALMLSG

SEQ ID NO: 948 - protein, 22 aa, Escherichia coli
  misc feature (1)..(22): Escherichia coli Q47231 Q47231 ECOLX
MKMTRLYPLALGGLLLPTIANA

SEQ ID NO: 949 - protein, 22 aa, Escherichia coli
  misc feature (1)..(22): Escherichia coli (strain K12) P28635 METQ ECOLI
MAFKFKTFAAVGALIGSLALVG

SEQ ID NO: 950 - protein, 22 aa, Escherichia coli
  misc feature (1)..(22): Escherichia coli P46004 AGGD ECOLX
MKIRRIVSTIAIALSVFTFAHA

SEQ ID NO: 951 - protein, 22 aa, Escherichia coli
  misc feature (1)..(22): Escherichia coli O111:NM Q1ELX6 Q1ELX6 ECOLX
MKKMFMAVLFALASVNAMAADC

SEQ ID NO: 952 - protein, 22 aa, Escherichia coli
  misc feature (1)..(22): Escherichia coli (strain ATCC 8739/DSM 1576/Crooks) B1IT18 B1IT18 ECOLC
MKQLLASPSLQLVTYPASATAQ

SEQ ID NO: 953 - protein, 22 aa, Escherichia coli
  misc feature (1)..(22): Escherichia coli (strain K12) P0AAX6 YBIM ECOLI
MKKCLTLLIATVLSGISLTAYA

SEQ ID NO: 954 - protein, 22 aa, Escherichia coli
  misc feature (1)..(22): Escherichia coli (strain ATCC 8739/DSM 1576/Crooks) B1IX87 B1IX87 ECOLC
MKRLIMATMVTAILASSTVWAA

SEQ ID NO: 955 - protein, 22 aa, Escherichia coli
  misc feature (1)..(22): Escherichia coli (strain K12) P76001 YCGJ ECOLI
MNMMRIFYIGLSGVGMMFSSMA

SEQ ID NO: 956 - protein, 22 aa, Escherichia coli
  misc feature (1)..(22): Escherichia coli (strain ATCC 8739/DSM 1576/Crooks) B1J0A2 B1J0A2 ECOLC
MNVLRSGLVTMLLLAAFSVQAA

SEQ ID NO: 957 - protein, 22 aa, Escherichia coli
  misc feature (1)..(22): Escherichia coli O157:H7 Q8X8Z0 BTUF ECO57
MAKSLFRALVALSFLAPLWLNA

SEQ ID NO: 958 - protein, 22 aa, Escherichia coli
  misc feature (1)..(22): Escherichia coli (strain K12) P03841 MALM ECOLI
MKMNKSLIVLCLSAGLLASAPG

SEQ ID NO: 959 - protein, 22 aa, Escherichia coli
  misc feature (1)..(22): Escherichia coli (strain ATCC 8739/DSM 1576/Crooks) B1IVU9 B1IVU9 ECOLC
MKKNSYLLSCLAIAVSSACHAE

SEQ ID NO: 960 - protein, 22 aa, Escherichia coli
  misc feature (1)..(22): Escherichia coli (strain K12) P33343 YEHD ECOLI
MKRSIIAAAVFSSFFMSAGVFA

SEQ ID NO: 961 - protein, 22 aa, Escherichia coli
  misc feature (1)..(22): Escherichia coli O157:H7 P0AB42 YCFR ECO57
MKNVKTLIAAAILSSMSFASFA

SEQ ID NO: 962 - protein, 22 aa, Escherichia coli
  misc feature (1)..(22): Escherichia coli (strain K12) P0A908 MIPA ECOLI
MTKLKLLALGVLIATSAGVAHA

SEQ ID NO: 963 - protein, 22 aa, Escherichia coli
  misc feature (1)..(22): Escherichia coli (strain ATCC 8739/DSM 1576/Crooks) B1IZI8 B1IZI8 ECOLC
MNLKKIFFSAVTVSVLCALTGC

SEQ ID NO: 964 - protein, 22 aa, Escherichia coli
  misc feature (1)..(22): Escherichia coli P0ABE7 C562 ECOLX
MRKSLLAILAVSSLVFSSASFA

SEQ ID NO: 965 - protein, 22 aa, Escherichia coli
  misc feature (1)..(22): Escherichia coli (strain ATCC 8739/DSM 1576/Crooks) B1IQB0 B1IQB0 ECOLC
MSIKTIKYFSTIIVAVVAVLAG

SEQ ID NO: 966 - protein, 22 aa, Escherichia coli
  misc feature (1)..(22): Escherichia coli (strain K12) P0A8X2 YCEI ECOLI
MKKSLLGLTFASLMFSAGSAVA

SEQ ID NO: 967 - protein, 22 aa, Escherichia coli
  misc feature (1)..(22): Escherichia coli (strain ATCC 8739/DSM 1576/Crooks) B1IVG5 B1IVG5 ECOLC
MRIVTAAVMASTLAVSSLSHAA

SEQ ID NO: 968 - protein, 22 aa, Escherichia coli
  misc feature (1)..(22): Escherichia coli (strain ATCC 8739/DSM 1576/Crooks) B1IV53 OPGG ECOLC
MMKMRWLSAAVMLTLYTSSSWA

SEQ ID NO: 969 - protein, 22 aa, Escherichia coli
  misc feature (1)..(22): Escherichia coli (strain K12) P28249 ASMA ECOLI
MRRFLTTLMILLVVLVAGLSAL

SEQ ID NO: 970 - protein, 22 aa, Escherichia coli
  misc feature (1)..(22): Escherichia coli P25733 CFAC ECOLX
MKHKKKNRLVVAISVALIPYIG

SEQ ID NO: 971 - protein, 22 aa, Escherichia coli
  misc feature (1)..(22): Escherichia coli (strain ATCC 8739/DSM 1576/Crooks) B1IPQ0 B1IPQ0 ECOLC
MKVFTFLLIIMVCLYNFGVRAA

SEQ ID NO: 972 - protein, 22 aa, Escherichia coli
  misc feature (1)..(22): Escherichia coli (strain ATCC 8739/DSM 1576/Crooks) B1IRY6 B1IRY6 ECOLC
MKLKIVAVVVTGLLAANVAHAA

SEQ ID NO: 973 - protein, 22 aa, Escherichia coli
  misc feature (1)..(22): Escherichia coli O157:H7 P0AAA4 MATB ECO57
MKKKVLAIALVTVFTGMGVAQA

SEQ ID NO: 974 - protein, 22 aa, Escherichia coli
  misc feature (1)..(22): Escherichia coli (strain ATCC 8739/DSM 1576/Crooks) B1IXT7 B1IXT7 ECOLC
MKKIALAGLAGMLLVSASVNAM

SEQ ID NO: 975 - protein, 22 aa, Escherichia coli
  misc feature (1)..(22): Escherichia coli Q03037 Q03037 ECOLX
MKCILFKWVLCLLLGFSSVSYS

SEQ ID NO: 976 - protein, 22 aa, Escherichia coli
  misc feature (1)..(22): Escherichia coli (strain K12) P42913 YRAH ECOLI
MNKVTKTAIAGLLALFAGNAAA

SEQ ID NO: 977 - protein, 22 aa, Escherichia coli
  misc feature (1)..(22): Escherichia coli O157:H7 P0A928 TSX ECO57
MKKTLLAAGAVLALSSSFTVNA

SEQ ID NO: 978 - protein, 22 aa, Escherichia coli
  misc feature (1)..(22): Escherichia coli (strain K12) P37902 GLTI ECOLI
MQLRKPATAILALALSAGLAQA

SEQ ID NO: 979 - protein, 22 aa, Escherichia coli
  misc feature (1)..(22): Escherichia coli O157:H7 P0ABW6 SFMA ECO57
MKLRFISSALAAALFAATGSYA

SEQ ID NO: 980 - protein, 22 aa, Escherichia coli
  misc feature (1)..(22): Escherichia coli (strain K12) P0AEU0 HISJ ECOLI
MKKLVLSLSLVLAFSSATAAFA

SEQ ID NO: 981 - protein, 22 aa, Escherichia coli
  misc feature (1)..(22): Escherichia coli (strain ATCC 8739/DSM 1576/Crooks) B1IQY3 B1IQY3 ECOLC
MGLVIKAALGALVVLLIGVLAK

SEQ ID NO: 982 - protein, 23 aa, Escherichia coli
  misc feature (1)..(23): Escherichia coli (strain ATCC 8739/DSM 1576/Crooks) B1IVN0 B1IVN0 ECOLC
MRFSHRLFLLLILLLTGAPILAQ

SEQ ID NO: 983 - protein, 23 aa, Escherichia coli
  misc feature (1)..(23): Escherichia coli (strain ATCC 8739/DSM 1576/Crooks) B1IQX1 B1IQX1 ECOLC
MKALSPIAVLISALLLQGCVAAA

SEQ ID NO: 984 - protein, 23 aa, Escherichia coli
  misc feature (1)..(23): Escherichia coli Q8GA85 Q8GA85 ECOLX
MSIQHFRVALIPFFAAFCLPVFA

SEQ ID NO: 985 - protein, 23 aa, Escherichia coli
  misc feature (1)..(23): Escherichia coli (strain ATCC 8739/DSM 1576/Crooks) B1IQV8 B1IQV8 ECOLC
MKPFLRWCFVATALTLAGCSNTS

SEQ ID NO: 986 - protein, 23 aa, Escherichia coli
  misc feature (1)..(23): Escherichia coli (strain ATCC 8739/DSM 1576/Crooks) B1IUF3 B1IUF3 ECOLC
MKNVKTLIAAAILSSMSFASFAA

SEQ ID NO: 987 - protein, 23 aa, Escherichia coli
  misc feature (1)..(23): Escherichia coli (strain K12) P04816 LIVK ECOLI
MKRNAKTIIAGMIALAISHTAMA

SEQ ID NO: 988 - protein, 23 aa, Escherichia coli
  misc feature (1)..(23): Escherichia coli (strain K12) P0A917 OMPX ECOLI
MKKIACLSALAAVLAFTAGTSVA

SEQ ID NO: 989 - protein, 23 aa, Escherichia coli
  misc feature (1)..(23): Escherichia coli O157:H7 Q8XB75 YEDX ECO57
MLKRYLVLSVVTAAFSLPSLVYA

SEQ ID NO: 990 - protein, 23 aa, Escherichia coli
  misc feature (1)..(23): Escherichia coli (strain ATCC 8739/DSM 1576/Crooks) B1IXG6 B1IXG6 ECOLC
MKTINTVVAAMALSTLSFGVFAA

SEQ ID NO: 991 - protein, 23 aa, Escherichia coli
  misc feature (1)..(23): Escherichia coli (strain ATCC 8739/DSM 1576/Crooks) B1IXC4 B1IXC4 ECOLC
MIMKNCLLLGALLMGFTGVAMAQ

SEQ ID NO: 992 - protein, 23 aa, Escherichia coli
  misc feature (1)..(23): Escherichia coli (strain ATCC 8739/DSM 1576/Crooks) B1IYF3 B1IYF3 ECOLC
MQLRKPAIAILALALSAGLAQAD

SEQ ID NO: 993 - protein, 23 aa, Escherichia coli
  misc feature (1)..(23): Escherichia coli (strain K12) P37050 YADN ECOLI
MSKKLGFALSGLMLAMVAGTASA

SEQ ID NO: 994 - protein, 23 aa, Escherichia coli
  misc feature (1)..(23): Escherichia coli (strain ATCC 8739/DSM 1576/Crooks) B1IRN7 B1IRN7 ECOLC
MKIKTILTPVTCALLISFSAHAA

SEQ ID NO: 995 - protein, 23 aa, Escherichia coli
  misc feature (1)..(23): Escherichia coli (strain K12) P0AFX9 RSEB ECOLI
MKQLWFAMSLVTGSLLFSANASA

SEQ ID NO: 996 - protein, 23 aa, Escherichia coli
  misc feature (1)..(23): Escherichia coli (strain ATCC 8739/DSM 1576/Crooks) B1IV57 B1IV57 ECOLC
MFRPFLNSLMLGSLFFPFIAIAG

SEQ ID NO: 997 - protein, 23 aa, Escherichia coli
  misc feature (1)..(23): Escherichia coli O1:K1/APEC A1AGY4 UGPB ECOK1
MKPLRYTASALALGLALMANAQA

SEQ ID NO: 998 - protein, 23 aa, Escherichia coli
  misc feature (1)..(23): Escherichia coli (strain K12) P75748 YBGO ECOLI
MSAGKGLLLVICLLFLPLKSAMA

SEQ ID NO: 999 - protein, 23 aa, Escherichia coli
  misc feature (1)..(23): Escherichia coli (strain ATCC 8739/DSM 1576/Crooks) B1IQI2 B1IQI2 ECOLC
MAKSLFRALVALSFLAPLWLNAA

SEQ ID NO: 1000 - protein, 23 aa, Escherichia coli
  misc feature (1)..(23): Escherichia coli (strain K12) P76344 YODA ECOLI
MAIRLYKLAVALGVFIVSAPAFS

SEQ ID NO: 1001 - protein, 23 aa, Escherichia coli
  misc feature (1)..(23): Escherichia coli P22542 HSTI ECOLX
MKKNIAFLLASMFVFSIATNAYA

SEQ ID NO: 1002 - protein, 23 aa, Escherichia coli
  misc feature (1)..(23): Escherichia coli Q8RL97 Q8RL97 ECOLX
MKIKTLAIAVLSALSLSSTAALA

SEQ ID NO: 1003 - protein, 23 aa, Escherichia coli
  misc feature (1)..(23): Escherichia coli O6 Q8CVG4 NANC ECOL6
MKKAKILSGVLLLCFSSPLISQA

SEQ ID NO: 1004 - protein, 23 aa, Escherichia coli
  misc feature (1)..(23): Escherichia coli O6 P0ADA8 OSMB ECOL6
MFVTSKKMTAAVLAITLAMSLSA

SEQ ID NO: 1005 - protein, 23 aa, Escherichia coli
  misc feature (1)..(23): Escherichia coli (strain ATCC 8739/DSM 1576/Crooks) B1IRR1 B1IRR1 ECOLC
MPKLRLIGLTLLALSATAVSHAE

SEQ ID NO: 1006 - protein, 23 aa, Escherichia coli
  misc feature (1)..(23): Escherichia coli P02971 FMC1 ECOLX
MKFKKTIGAMALTTMFVAVSASA

SEQ ID NO: 1007 - protein, 23 aa, Escherichia coli
  misc feature (1)..(23): Escherichia coli (strain ATCC 8739/DSM 1576/Crooks) B1ITH5 B1ITH5 ECOLC
MKYLLIFLLVLAIFVISVTLGAQ

SEQ ID NO: 1008 - protein, 23 aa, Escherichia coli
  misc feature (1)..(23): Escherichia coli P43529 E2BB ECOLX
MSFKKIIKAFVIMAALVSVQAHA

SEQ ID NO: 1009 - protein, 23 aa, Escherichia coli
  misc feature (1)..(23): Escherichia coli (strain ATCC 8739/DSM 1576/Crooks) B1IQK3 B1IQK3 ECOLC
MKLKAIAILIVTGGMISHSALAG

SEQ ID NO: 1010 - protein, 23 aa, Escherichia coli
  misc feature (1)..(23): Escherichia coli (strain ATCC 8739/DSM 1576/Crooks) B1IRV4 B1IRV4 ECOLC
MKYNNIIFLGLCLGLTTYSALSA

SEQ ID NO: 1011 - protein, 23 aa, Escherichia coli
  misc feature (1)..(23): Escherichia coli Q5D223 Q5D223 ECOLX
MKRVITLFAVLLMGWSVNAWSFA

SEQ ID NO: 1012 - protein, 23 aa, Escherichia coli
  misc feature (1)..(23): Escherichia coli (strain ATCC 8739/DSM 1576/Crooks) B1ISL1 B1ISL1 ECOLC
MFTKALSVVLLTCALFSGQLMAG

SEQ ID NO: 1013 - protein, 23 aa, Escherichia coli
  misc feature (1)..(23): Escherichia coli O1:K1/APEC A1A765 YAAI ECOK1
MKSVITISASLAISLMLCCTAQA

SEQ ID NO: 1014 - protein, 23 aa, Escherichia coli
  misc feature (1)..(23): Escherichia coli (strain K12) P33362 OSMF ECOLI
MPLLKLWAGSLVMLAAVSLPLQA

SEQ ID NO: 1015 - protein, 23 aa, Escherichia coli
  misc feature (1)..(23): Escherichia coli (strain UTI89/UPEC) Q1R5H5 UGPB ECOUT
MKPLRYTASALALGLALMANAQA

SEQ ID NO: 1016 - protein, 23 aa, Escherichia coli
  misc feature (1)..(23): Escherichia coli P62593 BLAT ECOLX
MSIQHFRVALIPFFAAFCLPVFA

SEQ ID NO: 1017 - protein, 23 aa, Escherichia coli
  misc feature (1)..(23): Escherichia coli O9:H4 (strain HS) A7ZVV5 YAAI ECOHS
MKSVFTISASLAISLMLCCTAQA

SEQ ID NO: 1018 - protein, 23 aa, Escherichia coli
  misc feature (1)..(23): Escherichia coli (strain K12) P37691 YIBQ ECOLI
MFPFRRNVLAFAALLALSSPVLA

SEQ ID NO: 1019 - protein, 23 aa, Escherichia coli
  misc feature (1)..(23): Escherichia coli O6 P64597 YRAP ECOL6
MKALSPIAVLISALLLQGCVAAA

SEQ ID NO: 1020 - protein, 23 aa, Escherichia coli
  misc feature (1)..(23): Escherichia coli (strain K12) P39265 ALSB ECOLI
MNKYLKYFSGTLVGLMLSTSAFA

SEQ ID NO: 1021 - protein, 23 aa, Escherichia coli
  misc feature (1)..(23): Escherichia coli (strain ATCC 8739/DSM 1576/Crooks) B1IR29 B1IR29 ECOLC
MKQQKAMLIALIVICLTVIVTAL

SEQ ID NO: 1022 - protein, 23 aa, Escherichia coli
  misc feature (1)..(23): Escherichia coli (strain K12) P0AEE5 DGAL ECOLI
MNKKVLTLSAVMASMLFGAAAHA

SEQ ID NO: 1023 - protein, 23 aa, Escherichia coli
  misc feature (1)..(23): Escherichia coli (strain K12) P37387 XYLF ECOLI
MKIKNILLTLCTSLLLTNVAAHA

SEQ ID NO: 1024 - protein, 23 aa, Escherichia coli
  misc feature (1)..(23): Escherichia coli (strain K12) P04128 FIMA1 ECOLI
MKIKTLAIVVLSALSLSSTAALA

SEQ ID NO: 1025 - protein, 23 aa, Escherichia coli
  misc feature (1)..(23): Escherichia coli (strain ATCC 8739/DSM 1576/Crooks) B1IST1 B1IST1 ECOLC
MKHSVSVTCCALLVSSISLSYAA

SEQ ID NO: 1026 - protein, 23 aa, Escherichia coli
  misc feature (1)..(23): Escherichia coli (strain ATCC 8739/DSM 1576/Crooks) B1IV58 B1IV58 ECOLC
MNALLLLAALSSQITFNTTQQGD

SEQ ID NO: 1027 - protein, 23 aa, Escherichia coli
  misc feature (1)..(23): Escherichia coli (strain K12) P05458 PTRA ECOLI
MPRSTWFKALLLLVALWAPLSQA

SEQ ID NO: 1028 - protein, 23 aa, Escherichia coli
  misc feature (1)..(23): Escherichia coli O6 P0AD97 LIVJ ECOL6
MNIKGKALLAGCIALAFSNMALA

SEQ ID NO: 1029 - protein, 23 aa, Escherichia coli
  misc feature (1)..(23): Escherichia coli O157:H7 Q8XC50 NLPA ECO57
MKLTTHHLRAGAALLLAGVLLAG

SEQ ID NO: 1030 - protein, 23 aa, Escherichia coli
  misc feature (1)..(23): Escherichia coli O6 P62606 FIM1C ECOL6
MKLKFISMAVFSALTLGVATNAS

SEQ ID NO: 1031 - protein, 23 aa, Escherichia coli
  misc feature (1)..(23): Escherichia coli Q47454 PCOC ECOLX
MSILNKAILTGGLVMGVAFSAMA

SEQ ID NO: 1032 - protein, 23 aa, Escherichia coli
  misc feature (1)..(23): Escherichia coli (strain ATCC 8739/DSM 1576/Crooks) B1IXN2 B1IXN2 ECOLC
MKKSILALSLLVGLSTAASSYAA

SEQ ID NO: 1033 - protein, 23 aa, Escherichia coli
  misc feature (1)..(23): Escherichia coli (strain K12) P32160 YIIQ ECOLI
MKPGCTLFFLLCSALTVTTEAHA

SEQ ID NO: 1034 - protein, 23 aa, Escherichia coli
  misc feature (1)..(23): Escherichia coli (strain K12) P76341 YEDX ECOLI
MLKRYLVLSVATAAFSLPSLVNA

SEQ ID NO: 1035 - protein, 23 aa, Escherichia coli
  misc feature (1)..(23): Escherichia coli P78144 P78144 ECOLX
MSIQHFRVALIPFFAAFCLPVFA

SEQ ID NO: 1036 - protein, 23 aa, Escherichia coli
  misc feature (1)..(23): Escherichia coli (strain K12) P45508 YFAL ECOLI
MRIIFLRKEYLSLLPSMIASLFS

SEQ ID NO: 1037 - protein, 23 aa, Escherichia coli
  misc feature (1)..(23): Escherichia coli P13661 BLO1 ECOLX
MKNTIHINFAIFLIIANIIYSSA

SEQ ID NO: 1038 - protein, 23 aa, Escherichia coli
  misc feature (1)..(23): Escherichia coli (strain K12) P64596 YRAP ECOLI
MKALSPIAVLISALLLQGCVAAA

SEQ ID NO: 1039 - protein, 23 aa, Escherichia coli
  misc feature (1)..(23): Escherichia coli (strain ATCC 8739/DSM 1576/Crooks) B1J111 B1J111 ECOLC
MQVGLTSSSLATGGAHSAAVSSS

SEQ ID NO: 1040 - protein, 23 aa, Escherichia coli
  misc feature (1)..(23): Escherichia coli P21413 FM98 ECOLX
MRMKKSALTLAVLSSLFSGYSLA

SEQ ID NO: 1041 - protein, 23 aa, Escherichia coli
  misc feature (1)..(23): Escherichia coli O157:H7 P69857 NANC ECO57
MKKAKILSGVLLLCFSSPLISQA

SEQ ID NO: 1042 - protein, 23 aa, Escherichia coli
  misc feature (1)..(23): Escherichia coli (strain ATCC 8739/DSM 1576/Crooks) B1ISC1 B1ISC1 ECOLC
MKKLLPILIGLSLSGFSSLSQAE

SEQ ID NO: 1043 - protein, 23 aa, Escherichia coli
  misc feature (1)..(23): Escherichia coli (strain ATCC 8739/DSM 1576/Crooks) B1IYW9 B1IYW9 ECOLC
MNKYWLSGIIFLAYGLASPAFSS

SEQ ID NO: 1044 - protein, 23 aa, Escherichia coli
  misc feature (1)..(23): Escherichia coli (strain K12) P04846 NLPA ECOLI
MKLTTHHLRTGAALLLAGILLAG

SEQ ID NO: 1045 - protein, 23 aa, Escherichia coli
  misc feature (1)..(23): Escherichia coli (strain ATCC 8739/DSM 1576/Crooks) B1IQ27 B1IQ27 ECOLC
MTKHARFFLLPSFILISAALIAG

SEQ ID NO: 1046 - protein, 23 aa, Escherichia coli
  misc feature (1)..(23): Escherichia coli (strain K12) P75954 YCFS ECOLI
MMIKTRFSRWLTFFTFAAAVALA

SEQ ID NO: 1047 - protein, 23 aa, Escherichia coli
  misc feature (1)..(23): Escherichia coli (strain ATCC 8739/DSM 1576/Crooks) B1J038 B1J038 ECOLC
MKKTLLAAGAVLALSSSFTVNAA

SEQ ID NO: 1048 - protein, 23 aa, Escherichia coli
  misc feature (1)..(23): Escherichia coli (strain K12) Q47706 UIDC ECOLI
MRKIVAMAVICLTAASGLTSAYA

SEQ ID NO: 1049 - protein, 23 aa, Escherichia coli
  misc feature (1)..(23): Escherichia coli O157:H7 P0AD98 LIVJ ECO57
MNIKGKALLAGCIALAFSNMALA

SEQ ID NO: 1050 - protein, 23 aa, Escherichia coli
  misc feature (1)..(23): Escherichia coli (strain ATCC 8739/DSM 1576/Crooks) B1IVU8 B1IVU8 ECOLC
MNKLQSYFIASVLYVMTPHAFAQ

SEQ ID NO: 1051 - protein, 23 aa, Escherichia coli
  misc feature (1)..(23): Escherichia coli O6 P0AEE6 DGAL ECOL6
MNKKVLTLSAVMASMLFGAAAHA

SEQ ID NO: 1052 - protein, 23 aa, Escherichia coli
  misc feature (1)..(23): Escherichia coli (strain ATCC 8739/DSM 1576/Crooks) B1IZ71 B1IZ71 ECOLC
MKLRFISSALAAALFAATGSYAA

SEQ ID NO: 1053 - protein, 23 aa, Escherichia coli
  misc feature (1)..(23): Escherichia coli (strain ATCC 8739/DSM 1576/Crooks) B1IR39 B1IR39 ECOLC
MNTKIRYGLSAAVLALIGAGASA

SEQ ID NO: 1054 - protein, 23 aa, Escherichia coli
  misc feature (1)..(23): Escherichia coli (strain ATCC 8739/DSM 1576/Crooks) B1IXW3 B1IXW3 ECOLC
MKNCVIVSAVRTAIGSFNGSLAS

SEQ ID NO: 1055 - protein, 23 aa, Escherichia coli
  misc feature (1)..(23): Escherichia coli (strain ATCC 8739/DSM 1576/Crooks) B1IYK8 B1IYK8 ECOLC
MNKSGKYLVWTVLSVMGAFALGY

SEQ ID NO: 1056 - protein, 23 aa, Escherichia coli
  misc feature (1)..(23): Escherichia coli (strain K12) P0AG80 UGPB ECOLI
MKPLHYTASALALGLALMGNAQA

SEQ ID NO: 1057 - protein, 23 aa, Escherichia coli
  misc feature (1)..(23): Escherichia coli (strain K12) P77249 SFMC ECOLI
MMTKIKLLMLIIFYLIISASAHA

SEQ ID NO: 1058 - protein, 23 aa, Escherichia coli
  misc feature (1)..(23): Escherichia coli (strain ATCC 8739/DSM 1576/Crooks) B1IQP1 B1IQP1 ECOLC
MKIKTTVAALSVLSVLSFGAFAA

SEQ ID NO: 1059 - protein, 23 aa, Escherichia coli
  misc feature (1)..(23): Escherichia coli Q47647 Q47647 ECOLX
MKIIIFRVLTFFFVIFSVNVVAK

SEQ ID NO: 1060 - protein, 23 aa, Escherichia coli
  misc feature (1)..(23): Escherichia coli P12050 FAND ECOLX
MNRKKHQILKILLLCLISSKSSA

SEQ ID NO: 1061 - protein, 23 aa, Escherichia coli
  misc feature (1)..(23): Escherichia coli Q47117 Q47117 ECOLX
MKLNKIIGALVLSSTFVSMGASA

SEQ ID NO: 1062 - protein, 23 aa, Escherichia coli
  misc feature (1)..(23): Escherichia coli (strain ATCC 8739/DSM 1576/Crooks) B1IPE9 B1IPE9 ECOLC
MTKLKLLALGVLIATSAGVAHAE

SEQ ID NO: 1063 - protein, 23 aa, Escherichia coli
  misc feature (1)..(23): Escherichia coli P0ABW7 CSOA ECOLX
MKLKKTIGAMALATLFATMGASA

SEQ ID NO: 1064 - protein, 23 aa, Escherichia coli
  misc feature (1)..(23): Escherichia coli (strain K12) P77754 SPY ECOLI
MRKLTALFVASTLALGAANLAHA

SEQ ID NO: 1065 - protein, 23 aa, Escherichia coli
  misc feature (1)..(23): Escherichia coli O52988 O52988 ECOLX
MQQRRALALLTLGSLLLAPCTYA

SEQ ID NO: 1066 - protein, 23 aa, Escherichia coli
  misc feature (1)..(23): Escherichia coli (strain ATCC 8739/DSM 1576/Crooks) B1IZ68 B1IZ68 ECOLC
MKIICRLLLAMACLWLTNISWAT

SEQ ID NO: 1067 - protein, 23 aa, Escherichia coli
  misc feature (1)..(23): Escherichia coli (strain ATCC 8739/DSM 1576/Crooks) B1J0X9 B1J0X9 ECOLC
MKKKVLAIALVTVFTGMGVAQAA

SEQ ID NO: 1068 - protein, 23 aa, Escherichia coli
  misc feature (1)..(23): Escherichia coli (strain K12) P77162 YKFB ECOLI
MTILSLSRFMLAGVLLASFNASA

SEQ ID NO: 1069 - protein, 23 aa, Escherichia coli
  misc feature (1)..(23): Escherichia coli (strain ATCC 8739/DSM 1576/Crooks) B1IVY9 B1IVY9 ECOLC
MLKRIIWILFLLGLTWGCELFAH

SEQ ID NO: 1070 - protein, 23 aa, Escherichia coli
  misc feature (1)..(23): Escherichia coli (strain K12) P37909 YBGD ECOLI
MFKGQKTLAALAVSLLFTAPVYA

SEQ ID NO: 1071 - protein, 23 aa, Escherichia coli
  misc feature (1)..(23): Escherichia coli (strain ATCC 8739/DSM 1576/Crooks) B1IYX2 B1IYX2 ECOLC
MLRMTPLASAIVALLLGIEAYAA

SEQ ID NO: 1072 - protein, 23 aa, Escherichia coli
  misc feature (1)..(23): Escherichia coli (strain ATCC 8739/DSM 1576/Crooks) B1IT62 B1IT62 ECOLC
MYRYLSIAAVVLSAAFSGPALAE

SEQ ID NO: 1073 - protein, 23 aa, Escherichia coli
  misc feature (1)..(23): Escherichia coli (strain ATCC 8739/DSM 1576/Crooks) B1J0F4 B1J0F4 ECOLC
MLSTLRRTLFALLACASFIVHAA

SEQ ID NO: 1074 - protein, 23 aa, Escherichia coli
  misc feature (1)..(23): Escherichia coli (strain K12) P32714 MDTP ECOLI
MINRQLSRLLLCSILGSTTLISG

SEQ ID NO: 1075 - protein, 23 aa, Escherichia coli
  misc feature (1)..(23): Escherichia coli O157:H7 P64598 YRAP ECO57
MKALSPIAVLISALLLQGCVAAA

SEQ ID NO: 1076 - protein, 23 aa, Escherichia coli
  misc feature (1)..(23): Escherichia coli (strain ATCC 8739/DSM 1576/Crooks) B1IUB3 B1IUB3 ECOLC
MKIKSISKAVLLFALLTSTSFAA

SEQ ID NO: 1077 - protein, 23 aa, Escherichia coli
  misc feature (1)..(23): Escherichia coli O157:H7 P0AG81 UGPB ECO57
MKPLHYTASALALGLALMGNAQA

SEQ ID NO: 1078 - protein, 23 aa, Escherichia coli
  misc feature (1)..(23): Escherichia coli O139:H28 (strain E24377A/ETEC) A7ZHA2 YAAI ECO24
MKSVFTISASLAISLMLCCTAQA

SEQ ID NO: 1079 - protein, 23 aa, Escherichia coli
  misc feature (1)..(23): Escherichia coli Q8RJ17 Q8RJ17 ECOLX
MKIKTLAIVVLSALSLSSTAALA

SEQ ID NO: 1080 - protein, 23 aa, Escherichia coli
  misc feature (1)..(23): Escherichia coli O6 P0A918 OMPX ECOL6
MKKIACLSALAAVLAFTAGTSVA

SEQ ID NO: 1081 - protein, 23 aa, Escherichia coli
  misc feature (1)..(23): Escherichia coli (strain ATCC 8739/DSM 1576/Crooks) B1IZ33 B1IZ33 ECOLC
MTNLKAVIPVAGLGMHMLPATKA

SEQ ID NO: 1082 - protein, 23 aa, Escherichia coli
  misc feature (1)..(23): Escherichia coli (strain K12) P28696 YAAI ECOLI
MKSVFTISASLAISLMLCCTAQA

SEQ ID NO: 1083 - protein, 23 aa, Escherichia coli
  misc feature (1)..(23): Escherichia coli (strain K12) Q46837 ACFD ECOLI
MNKKFKYKKSLLAAILSATLLAG

SEQ ID NO: 1084 - protein, 23 aa, Escherichia coli
  misc feature (1)..(23): Escherichia coli (strain ATCC 8739/DSM 1576/Crooks) B1J0Q8 B1J0Q8 ECOLC
MNMFFRLTALAGLLAIAGQTFAV

SEQ ID NO: 1085 - protein, 23 aa, Escherichia coli
  misc feature (1)..(23): Escherichia coli (strain ATCC 8739/DSM 1576/Crooks) B1IYZ2 B1IYZ2 ECOLC
MKKIAAISLISIFIMSGCAVHND

SEQ ID NO: 1086 - protein, 23 aa, Escherichia coli
  misc feature (1)..(23): Escherichia coli (strain ATCC 8739/DSM 1576/Crooks) B1J0E0 B1J0E0 ECOLC
MERFDAIIIGAGAAGMFCSALAG

SEQ ID NO: 1087 - protein, 23 aa, Escherichia coli
  misc feature (1)..(23): Escherichia coli O85184 O85184 ECOLX
MNKLTKGALVTLLSLSFCGQSMA

SEQ ID NO: 1088 - protein, 23 aa, Escherichia coli
  misc feature (1)..(23): Escherichia coli O157:H7 Q8X6M8 PTRA ECO57
MPRSTWFKALLLLVALWAPLSQA

SEQ ID NO: 1089 - protein, 23 aa, Escherichia coli
  misc feature (1)..(23): Escherichia coli (strain UTI89/UPEC) Q1RGJ0 YAAI ECOUT
MKSVITISASLAISLMLCCTAQA

SEQ ID NO: 1090 - protein, 23 aa, Escherichia coli
  misc feature (1)..(23): Escherichia coli (strain K12) P24180 ACRE ECOLI
MTKHARFFLLPSFILISAALIAG

SEQ ID NO: 1091 - protein, 23 aa, Escherichia coli
  misc feature (1)..(23): Escherichia coli (strain ATCC 8739/DSM 1576/Crooks) B1ISW9 B1ISW9 ECOLC
MRKSLLAILAVSSLVFSSASFAA

SEQ ID NO: 1092 - protein, 23 aa, Escherichia coli
  misc feature (1)..(23): Escherichia coli Q7BCY0 Q7BCY0 ECOLX
MQQRQSILWGAVATLMWAGLAHA

SEQ ID NO: 1093 - protein, 23 aa, Escherichia coli
  misc feature (1)..(23): Escherichia coli O157:H7 Q7BSW8 KATG2 ECO57
MIKKTLPVLILLALSGSFSTAVA

SEQ ID NO: 1094 - protein, 23 aa, Escherichia coli
  misc feature (1)..(23): Escherichia coli (strain ATCC 8739/DSM 1576/Crooks) B1J079 B1J079 ECOLC
MAISSRNTLLAALAFIAFQAQAV

SEQ ID NO: 1095 - protein, 23 aa, Escherichia coli
  misc feature (1)..(23): Escherichia coli O6 P0ABW8 CSOA ECOL6
MKLKKTIGAMALATLFATMGASA

SEQ ID NO: 1096 - protein, 23 aa, Escherichia coli
  misc feature (1)..(23): Escherichia coli O157:H7 Q8XA68 YAAI ECO57
MKSVFTISASLAISLMLCCTAQA

SEQ ID NO: 1097 - protein, 23 aa, Escherichia coli
  misc feature (1)..(23): Escherichia coli Q8RL99 Q8RL99 ECOLX
MKIKTLAIVVLSALLLSSTAALA

SEQ ID NO: 1098 - protein, 23 aa, Escherichia coli
  misc feature (1)..(23): Escherichia coli (strain K12) P45758 GSPD ECOLI
MKGLNKITCCLLAALLMPCAGHA

SEQ ID NO: 1099 - protein, 23 aa, Escherichia coli
  misc feature (1)..(23): Escherichia coli Q99PX9 Q99PX9 ECOLX
MQQRQSILWGAVATLMWAGLAHA

SEQ ID NO: 1100 - protein, 23 aa, Escherichia coli
  misc feature (1)..(23): Escherichia coli (strain K12) P69856 NANC ECOLI
MKKAKILSGVLLLCFSSPLISQA

SEQ ID NO: 1101 - protein, 23 aa, Escherichia coli
  misc feature (1)..(23): Escherichia coli (strain K12) P37018 YADM ECOLI
MIKTTPHKIVILMGILLSPSVFA

SEQ ID NO: 1102 - protein, 23 aa, Escherichia coli
  misc feature (1)..(23): Escherichia coli O6 Q8CVH8 MDTP ECOL6
MINRQLSRLLLCSILGSTTLISG

SEQ ID NO: 1103 - protein, 23 aa, Escherichia coli
  misc feature (1)..(23): Escherichia coli (strain ATCC 8739/DSM 1576/Crooks) B1ITD9 B1ITD9 ECOLC
MSNSISLIAILSLFTLLPFIIAS

SEQ ID NO: 1104 - protein, 23 aa, Escherichia coli
  misc feature (1)..(23): Escherichia coli (strain ATCC 8739/DSM 1576/Crooks) B1IT37 B1IT37 ECOLC
MMYRIRNWLVATLLLLCTPVGAA

SEQ ID NO: 1105 - protein, 23 aa, Escherichia coli
  misc feature (1)..(23): Escherichia coli (strain ATCC 8739/DSM 1576/Crooks) B1IV62 B1IV62 ECOLC
MKRYLRWIVAAEFLFAAGNLHAV

SEQ ID NO: 1106 - protein, 23 aa, Escherichia coli
  misc feature (1)..(23): Escherichia coli (strain ATCC 8739/DSM 1576/Crooks) B1IS19 B1IS19 ECOLC
MSKTFARSSLCALSMTIMTAHAA

SEQ ID NO: 1107 - protein, 23 aa, Escherichia coli
  misc feature (1)..(23): Escherichia coli (strain ATCC 8739/DSM 1576/Crooks) B1IRW4 B1IRW4 ECOLC
MRNLCFLLTLVATLLLPGRLIAA

SEQ ID NO: 1108 - protein, 23 aa, Escherichia coli
  misc feature (1)..(23): Escherichia coli Q8GL53 Q8GL53 ECOLX
  misc feature (12)..(12): Xaa can be any naturally occurring amino acid
MKAFWRNAALLXVSLLPFSSANA

SEQ ID NO: 1109 - protein, 23 aa, Escherichia coli
  misc feature (1)..(23): Escherichia coli (strain ATCC 8739/DSM 1576/Crooks) B1J104 B1J104 ECOLC
MKKIVVAGVVSAVLALVVGAGAG

SEQ ID NO: 1110 - protein, 23 aa, Escherichia coli
  misc feature (1)..(23): Escherichia coli (strain ATCC 8739/DSM 1576/Crooks) B1IYM3 B1IYM3 ECOLC
MNKKIHSLALLVNLGIYGVAQAQ

SEQ ID NO: 1111 - protein, 23 aa, Escherichia coli
  misc feature (1)..(23): Escherichia coli (strain ATCC 8739/DSM 1576/Crooks) B1ITW8 B1ITW8 ECOLC
MKRFPLFLLFTLLTLSTVPAQAD

SEQ ID NO: 1112 - protein, 23 aa, Escherichia coli
  misc feature (1)..(23): Escherichia coli (strain ATCC 8739/DSM 1576/Crooks) B1IYC5 B1IYC5 ECOLC
MLKRVFLSLLVLIGLLLLTVLGL

SEQ ID NO: 1113 - protein, 23 aa, Escherichia coli
  misc feature (1)..(23): Escherichia coli (strain ATCC 8739/DSM 1576/Crooks) B1IQE3 B1IQE3 ECOLC
MAFKFKTFAAVGALIGSLALVGC

SEQ ID NO: 1114 - protein, 23 aa, Escherichia coli
  misc feature (1)..(23): Escherichia coli O6 Q8CVL9 UGPB ECOL6
MKPLRYTASALALGLALMANAQA

SEQ ID NO: 1115 - protein, 23 aa, Escherichia coli
  misc feature (1)..(23): Escherichia coli (strain K12) P76193 YNHG ECOLI
MKRASLLTLTLIGAFSAIQAAWA

SEQ ID NO: 1116 - protein, 23 aa, Escherichia coli
  misc feature (1)..(23): Escherichia coli O6 Q8CWE7 YAAI ECOL6
MKSVITISASLAISLMLCCTAQA

SEQ ID NO: 1117 - protein, 23 aa, Escherichia coli
  misc feature (1)..(23): Escherichia coli O6:K15:H31 (strain 536/UPEC) Q0TC07 UGPB ECOL5
MKPLRYTASALALGLALMANAQA

SEQ ID NO: 1118 - protein, 23 aa, Escherichia coli
  misc feature (1)..(23): Escherichia coli (strain K12) P08190 FIMG ECOLI
MKWCKRGYVLAAILALASATIQA

SEQ ID NO: 1119 - protein, 23 aa, Escherichia coli
  misc feature (1)..(23): Escherichia coli (strain K12) P02924 ARAF ECOLI
MHKFTKALAAIGLAAVMSQSAMA

SEQ ID NO: 1120 - protein, 23 aa, Escherichia coli
  misc feature (1)..(23): Escherichia coli Q47123 Q47123 ECOLX
MKLKKTIGAMALSTIFVAVSASA

SEQ ID NO: 1121 - protein, 23 aa, Escherichia coli
  misc feature (1)..(23): Escherichia coli (strain K12) P21338 RNI ECOLI
MKAFWRNAALLAVSLLPFSSANA

SEQ ID NO: 1122 - protein, 23 aa, Escherichia coli
  misc feature (1)..(23): Escherichia coli (strain K12) P0AFK9 POTD ECOLI
MKKWSRHLLAAGALALGMSAAHA

SEQ ID NO: 1123 - protein, 23 aa, Escherichia coli
  misc feature (1)..(23): Escherichia coli (strain ATCC 8739/DSM 1576/Crooks) B1IXB3 B1IXB3 ECOLC
MKILRYVFYFLLLICLSTGVQAA

SEQ ID NO: 1124 - protein, 23 aa, Escherichia coli
  misc feature (1)..(23): Escherichia coli (strain K12) P78067 YNJE ECOLI
MKRVSQMTALAMALGLACASSWA

SEQ ID NO: 1125 - protein, 23 aa, Escherichia coli
  misc feature (1)..(23): Escherichia coli P0C8F0 KATG ECOLX
MIKKTLPVLILLALSGSFSTAVA

SEQ ID NO: 1126 - protein, 23 aa, Escherichia coli
  misc feature (1)..(23): Escherichia coli (strain ATCC 8739/DSM 1576/Crooks) B1IXG2 B1IXG2 ECOLC
MKKCLTLLIATVLSGISLTAYAA

SEQ ID NO: 1127 - protein, 23 aa, Escherichia coli
  misc feature (1)..(23): Escherichia coli (strain ATCC 8739/DSM 1576/Crooks) B1IQX9 B1IQX9 ECOLC
MNKGTKIAIAGLLALFAGNAAAT

SEQ ID NO: 1128 - protein, 23 aa, Escherichia coli
  misc feature (1)..(23): Escherichia coli (strain ATCC 8739/DSM 1576/Crooks) B1IYL7 B1IYL7 ECOLC
MIYVSRRLLITCLLLVSACVVAG

SEQ ID NO: 1129 - protein, 23 aa, Escherichia coli
  misc feature (1)..(23): Escherichia coli (strain K12) P34210 OMPP ECOLI
MQTKLLAIMLAAPVVFSSQEASA

SEQ ID NO: 1130 - protein, 23 aa, Escherichia coli
  misc feature (1)..(23): Escherichia coli Q8GID8 Q8GID8 ECOLX
MKAFWRNAALLAVSLLPFSSANA

SEQ ID NO: 1131 - protein, 23 aa, Escherichia coli
  misc feature (1)..(23): Escherichia coli Q8RL98 Q8RL98 ECOLX
MKIKTLAIVVLSALSLSSTAALA

SEQ ID NO: 1132 - protein, 23 aa, Escherichia coli
  misc feature (1)..(23): Escherichia coli (strain K12) P21420 NMPC ECOLI
MKKLTVAISAVAASVLMAMSAQA

SEQ ID NO: 1133 - protein, 23 aa, Escherichia coli
  misc feature (1)..(23): Escherichia coli (strain K12) P76206 YDIY ECOLI
MKLLKTVPAIVMLAGGMFASLNA

SEQ ID NO: 1134 - protein, 23 aa, Escherichia coli
  misc feature (1)..(23): Escherichia coli (strain ATCC 8739/DSM 1576/Crooks) B1IPN5 B1IPN5 ECOLC
MKRSTQLTLGLGLLALAPLAIAQ

SEQ ID NO: 1135 - protein, 23 aa, Escherichia coli
  misc feature (1)..(23): Escherichia coli (strain K12) P0AD96 LIVJ ECOLI
MNIKGKALLAGCIALAFSNMALA

SEQ ID NO: 1136 - protein, 23 aa, Escherichia coli
  misc feature (1)..(23): Escherichia coli (strain K12) P0ADA7 OSMB ECOLI
MFVTSKKMTAAVLAITLAMSLSA

SEQ ID NO: 1137 - protein, 23 aa, Escherichia coli
  misc feature (1)..(23): Escherichia coli (strain ATCC 8739/DSM 1576/Crooks) B1IT50 B1IT50 ECOLC
MEFFKKTALAALVMGFSGAALAL

SEQ ID NO: 1138 - protein, 23 aa, Escherichia coli
  misc feature (1)..(23): Escherichia coli O157:H7 P0A919 OMPX ECO57
MKKIACLSALAAVLAFTAGTSVA

SEQ ID NO: 1139 - protein, 23 aa, Escherichia coli
  misc feature (1)..(23): Escherichia coli Q540P6 Q540P6 ECOLX
MKAFWRNAALLAVSLLPFSSANA

SEQ ID NO: 1140 - protein, 23 aa, Escherichia coli
  misc feature (1)..(23): Escherichia coli (strain ATCC 8739/DSM 1576/Crooks) B1IVV0 B1IVV0 ECOLC
MKKNIFKFSVLTLAVLSLTACTL

SEQ ID NO: 1141 - protein, 23 aa, Escherichia coli
  misc feature (1)..(23): Escherichia coli (strain ATCC 8739/DSM 1576/Crooks) B1IRG1 YAAI ECOLC
MKSVFTISASLAISLMLCCTAQA

SEQ ID NO: 1142 - protein, 23 aa, Escherichia coli
  misc feature (1)..(23): Escherichia coli (strain ATCC 8739/DSM 1576/Crooks) B1ITH6 B1ITH6 ECOLC
MRSIARRTAVGAALLLVMPVAVW

SEQ ID NO: 1143 - protein, 23 aa, Escherichia coli
  misc feature (1)..(23): Escherichia coli P62605 FIM1C ECOLX
MKLKFISMAVFSALTLGVATNAS

SEQ ID NO: 1144 - protein, 23 aa, Escherichia coli
  misc feature (1)..(23): Escherichia coli O6:K15:H31 (strain 536/UPEC) Q0TLX6 YAAI ECOL5
MKSVITISASLAISLMLCCTAQA

SEQ ID NO: 1145 - protein, 23 aa, Escherichia coli
  misc feature (1)..(23): Escherichia coli (strain K12) P77294 YDER ECOLI
MKRLHKRFLLATFCALFTATLQA

SEQ ID NO: 1146 - protein, 23 aa, Escherichia coli
  misc feature (1)..(23): Escherichia coli O6 Q8CVS2 PTRA ECOL6
MPRSIWFKALLLFVALWAPLSQA

SEQ ID NO: 1147 - protein, 23 aa, Escherichia coli
  misc feature (1)..(23): Escherichia coli (strain ATCC 8739/DSM 1576/Crooks) B1IYX0 B1IYX0 ECOLC
MKRSIIAAAVFSSFFMSAGVFAA

SEQ ID NO: 1148 - protein, 23 aa, Escherichia coli
  misc feature (1)..(23): Escherichia coli Q47453 PCOB ECOLX
MKRNLKAIPVLVAGLFTSQLSIA

SEQ ID NO: 1149 - protein, 23 aa, Escherichia coli
  misc feature (1)..(23): Escherichia coli (strain K12) P52135 YFJT ECOLI
MKIRSLSRFVLASTMFASFTASA

SEQ ID NO: 1150 - protein, 23 aa, Escherichia coli
  misc feature (1)..(23): Escherichia coli O157:H7 Q8X5R9 MDTP ECO57
MINRQLSRLLLCSILGSTTLISG

SEQ ID NO: 1151 - protein, 23 aa, Escherichia coli
  misc feature (1)..(23): Escherichia coli O157:H7 P0AFY0 RSEB ECO57
MKQLWFAMSLVTGSLLFSANASA

SEQ ID NO: 1152 - protein, 23 aa, Escherichia coli
  misc feature (1)..(23): Escherichia coli (strain ATCC 8739/DSM 1576/Crooks) B1IP95 B1IP95 ECOLC
MNKFIKVALVGAVLATLTACTGH

SEQ ID NO: 1153 - protein, 23 aa, Escherichia coli
  misc feature (1)..(23): Escherichia coli (strain K12) P39834 YGIL ECOLI
MSAFKKSLLVAGVAMILSNNVFA

SEQ ID NO: 1154 - protein, 23 aa, Escherichia coli
  misc feature (1)..(23): Escherichia coli (strain ATCC 8739/DSM 1576/Crooks) B1IV46 B1IV46 ECOLC
MKKSLLGLTFASLMFSAGSAVAA

SEQ ID NO: 1155 - protein, 23 aa, Escherichia coli
  misc feature (1)..(23): Escherichia coli (strain ATCC 8739/DSM 1576/Crooks) B1IYN5 B1IYN5 ECOLC
MKKALQVAMFSLFTVIGFNAQAN

SEQ ID NO: 1156 - protein, 23 aa, Escherichia coli
  misc feature (1)..(23): Escherichia coli (strain ATCC 8739/DSM 1576/Crooks) B1IW02 B1IW02 ECOLC
MMKRNILAVIVPALLVAGTANAA

SEQ ID NO: 1157 - protein, 23 aa, Escherichia coli
  misc feature (1)..(23): Escherichia coli (strain ATCC 8739/DSM 1576/Crooks) B1IXF7 B1IXF7 ECOLC
MKSVLKVSLAALTLAFAVSSHAA

SEQ ID NO: 1158 - protein, 23 aa, Escherichia coli
  misc feature (1)..(23): Escherichia coli (strain ATCC 8739/DSM 1576/Crooks) B1IVL7 B1IVL7 ECOLC
MRCKTLTAAAAVLLMLTAGCSTL

SEQ ID NO: 1159 - protein, 23 aa, Escherichia coli
  misc feature (1)..(23): Escherichia coli O157:H7 P0ADA9 OSMB ECO57
MFVTSKKMTAAVLAITLAMSLSA

SEQ ID NO: 1160 - protein, 23 aa, Escherichia coli
  misc feature (1)..(23): Escherichia coli Q47207 Q47207 ECOLX
MKRRVFCSVFFIAILLGSKQCLA

SEQ ID NO: 1161 - protein, 23 aa, Escherichia coli
  misc feature (1)..(23): Escherichia coli (strain ATCC 8739/DSM 1576/Crooks) B1IV95 B1IV95 ECOLC
MNKTLIAAAVAGIVLLASNAQAQ

SEQ ID NO: 1162 - protein, 23 aa, Escherichia coli
  misc feature (1)..(23): Escherichia coli (strain ATCC 8739/DSM 1576/Crooks) B1IW39 B1IW39 ECOLC
MLTKKKWALFSLLTLCGGTIYKL

SEQ ID NO: 1163 - protein, 23 aa, Escherichia coli
  misc feature (1)..(23): Escherichia coli (strain ATCC 8739/DSM 1576/Crooks) B1IYD8 B1IYD8 ECOLC
MTYLRINPVLALLLLLTAIAAAL

SEQ ID NO: 1164 - protein, 23 aa, Escherichia coli
  misc feature (1)..(23): Escherichia coli (strain K12) P75616 YAAX ECOLI
MKKMQSIVLALSLVLVAPMAAQA

SEQ ID NO: 1165 - protein, 23 aa, Escherichia coli
  misc feature (1)..(23): Escherichia coli (strain ATCC 8739/DSM 1576/Crooks) B1IXN3 B1IXN3 ECOLC
MKKLVLSLSLVLAFSSATAAFAA

SEQ ID NO: 1166 - protein, 23 aa, Escherichia coli
  misc feature (1)..(23): Escherichia coli (strain K12) P76115 YNCD ECOLI
MKIFSVRQTVLPALLVLSPVVFA

SEQ ID NO: 1167 - protein, 23 aa, Escherichia coli
  misc feature (1)..(23): Escherichia coli (strain ATCC 8739/DSM 1576/Crooks) B1IQY6 B1IQY6 ECOLC
MKLKNTLLASALLSATAFSVNAA

SEQ ID NO: 1168 - protein, 23 aa, Escherichia coli
  misc feature (1)..(23): Escherichia coli (strain ATCC 8739/DSM 1576/Crooks) B1J115 B1J115 ECOLC
MQNWIKTVVVAVSLALPGVVLAQ

SEQ ID NO: 1169 - protein, 24 aa, Escherichia coli
  misc feature (1)..(24): Escherichia coli (strain ATCC 8739/DSM 1576/Crooks) B1IVF9 B1IVF9 ECOLC
MKPGCTLFFLLCSALTVTTAAHAQ

SEQ ID NO: 1170 - protein, 24 aa, Escherichia coli
  misc feature (1)..(24): Escherichia coli (strain ATCC 8739/DSM 1576/Crooks) B1IWB3 B1IWB3 ECOLC
MSFATISVIGLGYIGLPTAAAFAS

SEQ ID NO: 1171 - protein, 24 aa, Escherichia coli
  misc feature (1)..(24): Escherichia coli (strain ATCC 8739/DSM 1576/Crooks) B1IPS9 B1IPS9 ECOLC
MKLLTSAALAASLCITSVTPAIAE

SEQ ID NO: 1172 - protein, 24 aa, Escherichia coli
  misc feature (1)..(24): Escherichia coli (strain ATCC 8739/DSM 1576/Crooks) B1IY10 B1IY10 ECOLC
MFKGQKTLAALAVSLLFTAPVYAA

SEQ ID NO: 1173 - protein, 24 aa, Escherichia coli
  misc feature (1)..(24): Escherichia coli Q4JH74 Q4JH74 ECOLX
MKWCKRGYVLAAILALASATIQAA

SEQ ID NO: 1174 - protein, 24 aa, Escherichia coli
  misc feature (1)..(24): Escherichia coli (strain K12) P15069 TRAH1 ECOLI
MMPRIKPLLVLCAALLTVTPAASA

SEQ ID NO: 1175 - protein, 24 aa, Escherichia coli
  misc feature (1)..(24): Escherichia coli (strain ATCC 8739/DSM 1576/Crooks) B1IY13 B1IY13 ECOLC
MSAGKGVLLVICLLFLPLKSALAL

SEQ ID NO: 1176 - protein, 24 aa, Escherichia coli
  misc feature (1)..(24): Escherichia coli (strain ATCC 8739/DSM 1576/Crooks) B1IPW4 B1IPW4 ECOLC
MTMLLPLFILVGFIAGYFVNAIAY

SEQ ID NO: 1177 - protein, 24 aa, Escherichia coli
  misc feature (1)..(24): Escherichia coli (strain UTI89/UPEC) Q1RGE3 OSTA ECOUT
MKKRIPTLLATMIATALYSQQGLA

SEQ ID NO: 1178 - protein, 24 aa, Escherichia coli
  misc feature (1)..(24): Escherichia coli O157:H7 P0AAY0 YBIS ECO57
MNMKLKTLFAAAFAVVGFCSTASA

SEQ ID NO: 1179 - protein, 24 aa, Escherichia coli
  misc feature (1)..(24): Escherichia coli (strain ATCC 8739/DSM 1576/Crooks) B1IX01 B1IX01 ECOLC
MENLNMDLLYMAAAVMMGLAAIGA

SEQ ID NO: 1180 - protein, 24 aa, Escherichia coli
  misc feature (1)..(24): Escherichia coli (strain ATCC 8739/DSM 1576/Crooks) B1IWX0 B1IWX0 ECOLC
MLGKVFFVVLSCSLLLNPLTTYAK

SEQ ID NO: 1181 - protein, 24 aa, Escherichia coli
  misc feature (1)..(24): Escherichia coli (strain ATCC 8739/DSM 1576/Crooks) B1IW96 B1IW96 ECOLC
MKNVFKALTVLLTLFSLTGCGLKG

SEQ ID NO: 1182 - protein, 24 aa, Escherichia coli
  misc feature (1)..(24): Escherichia coli (strain ATCC 8739/DSM 1576/Crooks) B1IPS0 B1IPS0 ECOLC
MRNSLKAVLFGAFSVMFSAGLNAE

SEQ ID NO: 1183 - protein, 24 aa, Escherichia coli
  misc feature (1)..(24): Escherichia coli (strain ATCC 8739/DSM 1576/Crooks) B1IUF5 B1IUF5 ECOLC
MNKSMLAGIGIGVAAALGVAAVAS

SEQ ID NO: 1184 - protein, 24 aa, Escherichia coli
  misc feature (1)..(24): Escherichia coli (strain K12) P75859 YCBU ECOLI
MKKKTIFQCVILFFSILNIHVGMA

SEQ ID NO: 1185 - protein, 24 aa, Escherichia coli
  misc feature (1)..(24): Escherichia coli (strain ATCC 8739/DSM 1576/Crooks) B1IPT1 B1IPT1 ECOLC
MKKLKGVISAAVLSLYLLTPAHAD

SEQ ID NO: 1186 - protein, 24 aa, Escherichia coli
  misc feature (1)..(24): Escherichia coli O6 P0ABJ2 CYOA ECOL6
MRLRKYNKSLGWLSLFAGTVLLSG

SEQ ID NO: 1187 - protein, 24 aa, Escherichia coli
  misc feature (1)..(24): Escherichia coli (strain ATCC 8739/DSM 1576/Crooks) B1IRM1 B1IRM1 ECOLC
MKKVFAKSLLVAAMFSVAGSALAV

SEQ ID NO: 1188 - protein, 24 aa, Escherichia coli
  misc feature (1)..(24): Escherichia coli (strain K12) P0ABJ1 CYOA ECOLI
MRLRKYNKSLGWLSLFAGTVLLSG

SEQ ID NO: 1189 - protein, 24 aa, Escherichia coli
  misc feature (1)..(24): Escherichia coli (strain ATCC 8739/DSM 1576/Crooks) B1IRG8 B1IRG8 ECOLC
MKKMQSIVLALSLVLVAPMAAQAA

SEQ ID NO: 1190 - protein, 24 aa, Escherichia coli
  misc feature (1)..(24): Escherichia coli (strain K12) P39297 YJFO ECOLI
MVSRKRNSVIYRFASLLLVLMLSA

SEQ ID NO: 1191 - protein, 24 aa, Escherichia coli
  misc feature (1)..(24): Escherichia coli O157:H7 P0AE07 ACRA ECO57
MNKNRGFTPLAVVLMLSGSLALTG

SEQ ID NO: 1192 - protein, 24 aa, Escherichia coli
  misc feature (1)..(24): Escherichia coli (strain ATCC 8739/DSM 1576/Crooks) B1IQD8 B1IQD8 ECOLC
MRKIVAMAVICLTDASGLTSAYAA

SEQ ID NO: 1193 - protein, 24 aa, Escherichia coli
  misc feature (1)..(24): Escherichia coli (strain ATCC 8739/DSM 1576/Crooks) B1IXK8 B1IXK8 ECOLC
MKKSILILGLTLIVSSQIPSAMAK

SEQ ID NO: 1194 - protein, 24 aa, Escherichia coli
  misc feature (1)..(24): Escherichia coli (strain ATCC 8739/DSM 1576/Crooks) B1IZM6 B1IZM6 ECOLC
MKIKNILLTLCTSLLLTNVAAHAK

SEQ ID NO: 1195 - protein, 24 aa, Escherichia coli
  misc feature (1)..(24): Escherichia coli (strain ATCC 8739/DSM 1576/Crooks) B1IQ78 B1IQ78 ECOLC
MKRASLLTLTLIGAFSAIQAAWAV

SEQ ID NO: 1196 - protein, 24 aa, Escherichia coli
  misc feature (1)..(24): Escherichia coli (strain K12) Q46834 YGHF ECOLI
MFWLMLLIISAKMAHSLWRYISFS

SEQ ID NO: 1197 - protein, 24 aa, Escherichia coli
  misc feature (1)..(24): Escherichia coli (strain K12) P0AAV6 YBGS ECOLI
MKMTKLATLFLTATLSLASGAALA

SEQ ID NO: 1198 - protein, 24 aa, Escherichia coli
  misc feature (1)..(24): Escherichia coli (strain ATCC 8739/DSM 1576/Crooks) B1IVQ6 B1IVQ6 ECOLC
MKQLWFAMSLVTGSLLFSANASAT

SEQ ID NO: 1199 - protein, 24 aa, Escherichia coli
  misc feature (1)..(24): Escherichia coli (strain K12) P37648 YHJJ ECOLI
MQGTKIRLLAGGLLMMATAGYVQA

SEQ ID NO: 1200 - protein, 24 aa, Escherichia coli
  misc feature (1)..(24): Escherichia coli (strain ATCC 8739/DSM 1576/Crooks) B1J0E4 B1J0E4 ECOLC
MDKSKRHLAWWVVGLLAVAAIVAW

SEQ ID NO: 1201 - protein, 24 aa, Escherichia coli
  misc feature (1)..(24): Escherichia coli P05818 BMAE ECOLX
MNLKKIAIASSVFAGITMALTCHA

SEQ ID NO: 1202 - protein, 24 aa, Escherichia coli
  misc feature (1)..(24): Escherichia coli (strain ATCC 8739/DSM 1576/Crooks) B1IUE4 B1IUE4 ECOLC
MKKWSRHLLAAGALALGMSAAHAD

SEQ ID NO: 1203 - protein, 24 aa, Escherichia coli
  misc feature (1)..(24): Escherichia coli P33782 FAEH ECOLX
MKITHHYKSLLSAIISVALFYSAA

SEQ ID NO: 1204 - protein, 24 aa, Escherichia coli
  misc feature (1)..(24): Escherichia coli (strain ATCC 8739/DSM 1576/Crooks) B1IWV7 B1IWV7 ECOLC
MKINNVALPISLAVILTGCVPHAS

SEQ ID NO: 1205 - protein, 24 aa, Escherichia coli
  misc feature (1)..(24): Escherichia coli (strain K12) P31554 OSTA ECOLI
MKKRIPTLLATMIATALYSQQGLA

SEQ ID NO: 1206 - protein, 24 aa, Escherichia coli
  misc feature (1)..(24): Escherichia coli O157:H7 P0AFL5 PPIA ECO57
MFKSTLAAMAAVFALSALSPAAMA

SEQ ID NO: 1207 - protein, 24 aa, Escherichia coli
  misc feature (1)..(24): Escherichia coli (strain ATCC 8739/DSM 1576/Crooks) B1IPW9 B1IPW9 ECOLC
MNKQSGMTLLEVLLAMSIFTAVAL

SEQ ID NO: 1208 - protein, 24 aa, Escherichia coli
  misc feature (1)..(24): Escherichia coli Q47114 Q47114 ECOLX
MIGGKSSKVVIVLSVLIGSSSGFA

SEQ ID NO: 1209 - protein, 24 aa, Escherichia coli
  misc feature (1)..(24): Escherichia coli O6 P0AAX9 YBIS ECOL6
MNMKLKTLFAAAFAVVGFCSTASA

SEQ ID NO: 1210 - protein, 24 aa, Escherichia coli
  misc feature (1)..(24): Escherichia coli O157:H7 Q8XA13 OSTA ECO57
MKKRIPTLLATMIATALYSQQGLA

SEQ ID NO: 1211 - protein, 24 aa, Escherichia coli
  misc feature (1)..(24): Escherichia coli O6 P0AFL4 PPIA ECOL6
MFKSTLAAMAAVFALSALSPAAMA

SEQ ID NO: 1212 - protein, 24 aa, Escherichia coli
  misc feature (1)..(24): Escherichia coli (strain ATCC 8739/DSM 1576/Crooks) B1IX19 B1IX19 ECOLC
MNIKIAALTLAIASGISAQWAIAA

SEQ ID NO: 1213 - protein, 24 aa, Escherichia coli
  misc feature (1)..(24): Escherichia coli O6 Q8CWE6 OSTA ECOL6
MKKRIPTLLATMIATALYSQQGLA

SEQ ID NO: 1214 - protein, 24 aa, Escherichia coli
  misc feature (1)..(24): Escherichia coli (strain ATCC 8739/DSM 1576/Crooks) B1IT02 B1IT02 ECOLC
MKIKVSAGIIGAVLMLSASQSWAV

SEQ ID NO: 1215 - protein, 24 aa, Escherichia coli
  misc feature (1)..(24): Escherichia coli (strain ATCC 8739/DSM 1576/Crooks) B1ISE1 B1ISE1 ECOLC
MKTIFTVGAVVLATCLLSGCVNEQ

SEQ ID NO: 1216 - protein, 24 aa, Escherichia coli
  misc feature (1)..(24): Escherichia coli (strain K12) P37329 MODA ECOLI
MARKWLNLFAGAALSFAVAGNALA

SEQ ID NO: 1217 - protein, 24 aa, Escherichia coli
  misc feature (1)..(24): Escherichia coli (strain ATCC 8739/DSM 1576/Crooks) B1IPI7 B1IPI7 ECOLC
MRKLTALFVASTLALGAANLAHAA

SEQ ID NO: 1218 - protein, 24 aa, Escherichia coli
  misc feature (1)..(24): Escherichia coli (strain K12) P39165 YCHO ECOLI
MSRFVPRIIPFYLLLLVAGGTANA

SEQ ID NO: 1219 - protein, 24 aa, Escherichia coli
  misc feature (1)..(24): Escherichia coli P42186 PRSE ECOLX
MKKIRGLCLPVMLGAVLMSQHVHA

SEQ ID NO: 1220 - protein, 24 aa, Escherichia coli
  misc feature (1)..(24): Escherichia coli (strain ATCC 8739/DSM 1576/Crooks) B1IYB9 B1IYB9 ECOLC
MNKKVLTLSAVMASMLFGAAAHAA

SEQ ID NO: 1221 - protein, 24 aa, Escherichia coli
  misc feature (1)..(24): Escherichia coli (strain ATCC 8739/DSM 1576/Crooks) B1IU23 B1IU23 ECOLC
MPRSTWFKALLLLVALWAPLSQAE

SEQ ID NO: 1222 - protein, 24 aa, Escherichia coli
  misc feature (1)..(24): Escherichia coli (strain ATCC 8739/DSM 1576/Crooks) B1IYH5 B1IYH5 ECOLC
MRKQWLGICIAAGMLAACTSDDGQ

SEQ ID NO: 1223 - protein, 24 aa, Escherichia coli
  misc feature (1)..(24): Escherichia coli P08407 PAPE ECOLX
MKKIRGLCLPVMLGAVLMSQHVHA

SEQ ID NO: 1224 - protein, 24 aa, Escherichia coli
  misc feature (1)..(24): Escherichia coli (strain ATCC 8739/DSM 1576/Crooks) B1IWH4 B1IWH4 ECOLC
MSYSVMFALLLLTPLLFSLLCFAC

SEQ ID NO: 1225 - protein, 24 aa, Escherichia coli
  misc feature (1)..(24): Escherichia coli (strain ATCC 8739/DSM 1576/Crooks) B1IZL5 B1IZL5 ECOLC
MAVLIFLGCLLGGIAIGLPIAWAL

SEQ ID NO: 1226 - protein, 24 aa, Escherichia coli
  misc feature (1)..(24): Escherichia coli (strain K12) P0A903 NLPB ECOLI
MAYSVQKSRLAKVAGVSLVLLLAA

SEQ ID NO: 1227 - protein, 24 aa, Escherichia coli
  misc feature (1)..(24): Escherichia coli (strain K12) P0AFL3 PPIA ECOLI
MFKSTLAAMAAVFALSALSPAAMA

SEQ ID NO: 1228 - protein, 24 aa, Escherichia coli
  misc feature (1)..(24): Escherichia coli (strain ATCC 8739/DSM 1576/Crooks) B1IYD7 B1IYD7 ECOLC
MPLSKVWAGSLVLLAAVSLPLHAA

SEQ ID NO: 1229 - protein, 24 aa, Escherichia coli
  misc feature (1)..(24): Escherichia coli (strain ATCC 8739/DSM 1576/Crooks) B1IXF4 B1IXF4 ECOLC
MKKIACLSALAAVLAFTAGTSVAA

SEQ ID NO: 1230 - protein, 24 aa, Escherichia coli
  misc feature (1)..(24): Escherichia coli (strain ATCC 8739/DSM 1576/Crooks) B1ITX1 B1ITX1 ECOLC
MNKYLKYFSGTLVGLMLSTSAFAA

SEQ ID NO: 1231 - protein, 24 aa, Escherichia coli
  misc feature (1)..(24): Escherichia coli (strain ATCC 8739/DSM 1576/Crooks) B1IXL4 B1IXL4 ECOLC
MNTFSVSRLALALAFGVTLTACSS

SEQ ID NO: 1232 - protein, 24 aa, Escherichia coli
  misc feature (1)..(24): Escherichia coli (strain ATCC 8739/DSM 1576/Crooks) B1IS08 B1IS08 ECOLC
MKIFSVRQTVLPALLALSPVVFAA

SEQ ID NO: 1233 - protein, 24 aa, Escherichia coli
  misc feature (1)..(24): Escherichia coli O6:K15:H31 (strain 536/UPEC) Q0TLT4 OSTA ECOL5
MKKRIPTLLATMIATALYSQQGLA

SEQ ID NO: 1234 - protein, 24 aa, Escherichia coli
  misc feature (1)..(24): Escherichia coli O157:H7 P0AD13 YEEZ ECO57
MKKVAIVGLGWLGMPLAMSLSARG

SEQ ID NO: 1235 - protein, 24 aa, Escherichia coli
  misc feature (1)..(24): Escherichia coli (strain ATCC 8739/DSM 1576/Crooks) B1IUG0 B1IUG0 ECOLC
MTKMSRYALITALAMFLAGCVGQR

SEQ ID NO: 1236 - protein, 24 aa, Escherichia coli
  misc feature (1)..(24): Escherichia coli (strain ATCC 8739/DSM 1576/Crooks) B1IX86 B1IX86 ECOLC
MKVNLILFSLFLLVSIMACNVFAF

SEQ ID NO: 1237 - protein, 24 aa, Escherichia coli
  misc feature (1)..(24): Escherichia coli (strain ATCC 8739/DSM 1576/Crooks) B1J0H2 B1J0H2 ECOLC
MKRNAKTIIAGMIALAISHTAMAD

SEQ ID NO: 1238 - protein, 24 aa, Escherichia coli
  misc feature (1)..(24): Escherichia coli (strain ATCC 8739/DSM 1576/Crooks) B1IPH3 B1IPH3 ECOLC
MKRVSQMTALAMALGLACASSWAA

SEQ ID NO: 1239 - protein, 24 aa, Escherichia coli
  misc feature (1)..(24): Escherichia coli (strain ATCC 8739/DSM 1576/Crooks) B1ITI8 B1ITI8 ECOLC
MAGKFRCILLLIAGLFVSSLSYAE

SEQ ID NO: 1240 - protein, 24 aa, Escherichia coli
  misc feature (1)..(24): Escherichia coli (strain ATCC 8739/DSM 1576/Crooks) B1IWH6 B1IWH6 ECOLC
MGVLFAALTTLCMLSLISAFYQAD

SEQ ID NO: 1241 - protein, 24 aa, Escherichia coli
  misc feature (1)..(24): Escherichia coli (strain ATCC 8739/DSM 1576/Crooks) B1IQM3 B1IQM3 ECOLC
MKMTLPFKPHVLALICSAGLCAAS

SEQ ID NO: 1242 - protein, 24 aa, Escherichia coli
  misc feature (1)..(24): Escherichia coli (strain ATCC 8739/DSM 1576/Crooks) B1IXZ5 B1IXZ5 ECOLC
MWYFAWILGTLLACSFGVITALAL

SEQ ID NO: 1243 - protein, 24 aa, Escherichia coli
  misc feature (1)..(24): Escherichia coli (strain ATCC 8739/DSM 1576/Crooks) B1IZH6 B1IZH6 ECOLC
MFPFRRNVLAFAALLALSSPVLAG

SEQ ID NO: 1244 - protein, 24 aa, Escherichia coli
  misc feature (1)..(24): Escherichia coli (strain ATCC 8739/DSM 1576/Crooks) B1IRE3 B1IRE3 ECOLC
MPKRTDIKSILILGAGPIVIGQAC

SEQ ID NO: 1245 - protein, 24 aa, Escherichia coli
  misc feature (1)..(24): Escherichia coli (strain ATCC 8739/DSM 1576/Crooks) B1IWA2 B1IWA2 ECOLC
MLKVLLLFVLLIAGIVVGPMIAGH

SEQ ID NO: 1246 - protein, 24 aa, Escherichia coli
  misc feature (1)..(24): Escherichia coli (strain ATCC 8739/DSM 1576/Crooks) B1IRS1 B1IRS1 ECOLC
MSAFKKSLLVAGVAMILSNNVFAD

SEQ ID NO: 1247 - protein, 24 aa, Escherichia coli
  misc feature (1)..(24): Escherichia coli O6:K15:H31 (strain 536/UPEC) P12730 SFAA ECOL5
MKLKFISMAVFSALTLGVATNASA

SEQ ID NO: 1248 - protein, 24 aa, Escherichia coli
  misc feature (1)..(24): Escherichia coli (strain ATCC 8739/DSM 1576/Crooks) B1IYR7 B1IYR7 ECOLC
MKRQRNVNLLLMLVLLVAVGQMAQ

SEQ ID NO: 1249 - protein, 24 aa, Escherichia coli
  misc feature (1)..(24): Escherichia coli (strain ATCC 8739/DSM 1576/Crooks) B1IVN6 B1IVN6 ECOLC
MTRMKYLVAAATLSLFLAGCSGSK

SEQ ID NO: 1250 - protein, 24 aa, Escherichia coli
  misc feature (1)..(24): Escherichia coli (strain ATCC 8739/DSM 1576/Crooks) B1ISV0 B1ISV0 ECOLC
MIKSKIVLLSALVSCALISGCKEE

SEQ ID NO: 1251 - protein, 24 aa, Escherichia coli
  misc feature (1)..(24): Escherichia coli (strain ATCC 8739/DSM 1576/Crooks) B1IXD5 B1IXD5 ECOLC
MSRINKFVLTVSLLIFIMISAVAC

SEQ ID NO: 1252 - protein, 24 aa, Escherichia coli
  misc feature (1)..(24): Escherichia coli (strain ATCC 8739/DSM 1576/Crooks) B1J0P2 B1J0P2 ECOLC
MANWLNQLQSLLGQSSSSTSSSAD

SEQ ID NO: 1253 - protein, 24 aa, Escherichia coli
  misc feature (1)..(24): Escherichia coli (strain K12) P37676 YIAO ECOLI
MKLRSVTYALFIAGLAAFSTSSLA

SEQ ID NO: 1254 - protein, 24 aa, Escherichia coli
  misc feature (1)..(24): Escherichia coli (strain ATCC 8739/DSM 1576/Crooks) B1IZU2 B1IZU2 ECOLC
MLKRYLVLSVATAAFSLPSLVYAA

SEQ ID NO: 1255 - protein, 24 aa, Escherichia coli
  misc feature (1)..(24): Escherichia coli (strain ATCC 8739/DSM 1576/Crooks) B1IPJ1 B1IPJ1 ECOLC
MNKNMAGILSAAAVLTMLAGCTAY

SEQ ID NO: 1256 - protein, 24 aa, Escherichia coli
  misc feature (1)..(24): Escherichia coli (strain ATCC 8739/DSM 1576/Crooks) B1J0H0 B1J0H0 ECOLC
MNIKGKALLAGCIALAFSNMALAE

SEQ ID NO: 1257 - protein, 24 aa, Escherichia coli
  misc feature (1)..(24): Escherichia coli (strain K12) P0AAX8 YBIS ECOLI
MNMKLKTLFAAAFAVVGFCSTASA

SEQ ID NO: 1258 - protein, 24 aa, Escherichia coli
  misc feature (1)..(24): Escherichia coli (strain K12) P25549 ASLA ECOLI
MEFSFSPKRLVVAVAAALPLMASA

SEQ ID NO: 1259 - protein, 24 aa, Escherichia coli
  misc feature (1)..(24): Escherichia coli (strain K12) P0AD12 YEEZ ECOLI
MKKVAIVGLGWLGMPLAMSLSARG

SEQ ID NO: 1260 - protein, 24 aa, Escherichia coli
  misc feature (1)..(24): Escherichia coli (strain K12) P13656 CHIA ECOLI
MKLNIFTKSMIGMGLVCSALPALA

SEQ ID NO: 1261 - protein, 24 aa, Escherichia coli
  misc feature (1)..(24): Escherichia coli O157:H7 Q8X6H3 PBL ECO57
MRSPKVKFLTIFTLSILITKMSFA

SEQ ID NO: 1262 - protein, 24 aa, Escherichia coli
  misc feature (1)..(24): Escherichia coli (strain ATCC 8739/DSM 1576/Crooks) B1IU28 B1IU28 ECOLC
MKGRWVKYLLMGTVVAMLAACSSK

SEQ ID NO: 1263 - protein, 24 aa, Escherichia coli
  misc feature (1)..(24): Escherichia coli P07110 PAPC ECOLX
MKDRIPFAVNNITCVILLSLFCNA

SEQ ID NO: 1264 - protein, 24 aa, Escherichia coli
  misc feature (1)..(24): Escherichia coli Q07686 Q07686 ECOLX
MKLKTFPKISLLALSIWYSHSSLA

SEQ ID NO: 1265 - protein, 24 aa, Escherichia coli
  misc feature (1)..(24): Escherichia coli (strain ATCC 8739/DSM 1576/Crooks) B1IZ70 B1IZ70 ECOLC
MMTKIKLLMLIIFYLIISASAHAA

SEQ ID NO: 1266 - protein, 24 aa, Escherichia coli
  misc feature (1)..(24): Escherichia coli (strain K12) P10423 IAP ECOLI
MFSALRHRTAALALGVCFILPVHA

SEQ ID NO: 1267 - protein, 24 aa, Escherichia coli
  misc feature (1)..(24): Escherichia coli (strain K12) P32128 YIHF ECOLI
MIRKSATGVIVALAVIWGGGTWYT

SEQ ID NO: 1268 - protein, 24 aa, Escherichia coli
  misc feature (1)..(24): Escherichia coli (strain ATCC 8739/DSM 1576/Crooks) B1J0Y2 B1J0Y2 ECOLC
MRVNLLITMIIFALIWPVTALRAA

SEQ ID NO: 1269 - protein, 24 aa, Escherichia coli
  misc feature (1)..(24): Escherichia coli (strain K12) P75715 SFMH ECOLI
MAMACLCLANISWATVCANSTGVA

SEQ ID NO: 1270 - protein, 24 aa, Escherichia coli
  misc feature (1)..(24): Escherichia coli (strain ATCC 8739/DSM 1576/Crooks) B1IP29 B1IP29 ECOLC
MTTLTLVLTAVGSVLLLLFLVMKA

SEQ ID NO: 1271 - protein, 24 aa, Escherichia coli
  misc feature (1)..(24): Escherichia coli (strain K12) Q46790 PBL ECOLI
MRSPKVKFLTIFTFCIFITKMSFA

SEQ ID NO: 1272 - protein, 24 aa, Escherichia coli
  misc feature (1)..(24): Escherichia coli (strain ATCC 8739/DSM 1576/Crooks) B1IPR0 B1IPR0 ECOLC
MSILNKAILTGGLVMGVAFSAMAH

SEQ ID NO: 1273 - protein, 24 aa, Escherichia coli
  misc feature (1)..(24): Escherichia coli (strain ATCC 8739/DSM 1576/Crooks) B1IQX8 B1IQX8 ECOLC
MSKRTFAVILTLLCSFCIGQALAG

SEQ ID NO: 1274 - protein, 24 aa, Escherichia coli
  misc feature (1)..(24): Escherichia coli (strain ATCC 8739/DSM 1576/Crooks) B1J0N1 B1J0N1 ECOLC
MLHKKTLLFAALSAALWGGATQAA

SEQ ID NO: 1275 - protein, 24 aa, Escherichia coli
  misc feature (1)..(24): Escherichia coli (strain ATCC 8739/DSM 1576/Crooks) B1IV33 B1IV33 ECOLC
MNLLKSLAAVSSMTMFSRVLGFAR

SEQ ID NO: 1276 - protein, 24 aa, Escherichia coli
  misc feature (1)..(24): Escherichia coli (strain K12) Q46835 YGHG ECOLI
MSIKQMPGRVLISLLLSVTGLLSG

SEQ ID NO: 1277 - protein, 24 aa, Escherichia coli
  misc feature (1)..(24): Escherichia coli P46006 AGGB ECOLX
MLKKSILPMSCGVLVMVMSGLLDA

SEQ ID NO: 1278 - protein, 24 aa, Escherichia coli
  misc feature (1)..(24): Escherichia coli (strain ATCC 8739/DSM 1576/Crooks) B1IZU4 B1IZU4 ECOLC
MKRLSITVRLTLLFILLLSVAGAG

SEQ ID NO: 1279 - protein, 24 aa, Escherichia coli
  misc feature (1)..(24): Escherichia coli (strain ATCC 8739/DSM 1576/Crooks) B1J0A3 B1J0A3 ECOLC
MRKFTLNIFTLSLGLAVMPMVEAA

SEQ ID NO: 1280 - protein, 24 aa, Escherichia coli
  misc feature (1)..(24): Escherichia coli (strain ATCC 8739/DSM 1576/Crooks) B1J0J0 B1J0J0 ECOLC
MHKFTKALAAIGLAAVMSQSAMAE

SEQ ID NO: 1281 - protein, 24 aa, Escherichia coli
  misc feature (1)..(24): Escherichia coli O1:K1/APEC A1A7A3 OSTA ECOK1
MKKRIPTLLATMIATALYSQQGLA

SEQ ID NO: 1282 - protein, 24 aa, Escherichia coli
  misc feature (1)..(24): Escherichia coli Q9F821 Q9F821 ECOLX
MELSFSPKLLVVAVAAALPLIASA

SEQ ID NO: 1283 - protein, 24 aa, Escherichia coli
  misc feature (1)..(24): Escherichia coli Q47190 Q47190 ECOLX
MKKIRGLCLPVMLGAVLMSQHVHA

SEQ ID NO: 1284 - protein, 24 aa, Escherichia coli
  misc feature (1)..(24): Escherichia coli (strain ATCC 8739/DSM 1576/Crooks) B1J0H7 B1J0H7 ECOLC
MKPLHYTASALALGLALMGNAQAV

SEQ ID NO: 1285 - protein, 24 aa, Escherichia coli
  misc feature (1)..(24): Escherichia coli (strain ATCC 8739/DSM 1576/Crooks) B1IRV5 B1IRV5 ECOLC
MKRLHKRFLLATFCALFTATLQAA

SEQ ID NO: 1286 - protein, 24 aa, Escherichia coli
  misc feature (1)..(24): Escherichia coli (strain K12) P0AE06 ACRA ECOLI
MNKNRGFTPLAVVLMLSGSLALTG

SEQ ID NO: 1287 - protein, 25 aa, Escherichia coli
  misc feature (1)..(25): Escherichia coli (strain ATCC 8739/DSM 1576/Crooks) B1IV87 B1IV87 ECOLC
MPKSVIIPAGSSAPLAPFVPGTLAD

SEQ ID NO: 1288 - protein, 25 aa, Escherichia coli
  misc feature (1)..(25): Escherichia coli (strain ATCC 8739/DSM 1576/Crooks) B1IPA1 B1IPA1 ECOLC
MFKSTLAAMAAVFALSALSPAAMAA

SEQ ID NO: 1289 - protein, 25 aa, Escherichia coli
  misc feature (1)..(25): Escherichia coli (strain ATCC 8739/DSM 1576/Crooks) B1IUB4 B1IUB4 ECOLC
MNMMRIFYIGLSGVGMMFSSMASGN

SEQ ID NO: 1290 - protein, 25 aa, Escherichia coli
  misc feature (1)..(25): Escherichia coli (strain ATCC 8739/DSM 1576/Crooks) B1IVZ0 B1IVZ0 ECOLC
MKKKTIFQCVILFFSILNIHVGMAG

SEQ ID NO: 1291 - protein, 25 aa, Escherichia coli
  misc feature (1)..(25): Escherichia coli (strain ATCC 8739/DSM 1576/Crooks) B1IYE5 B1IYE5 ECOLC
MKAFNKLFSLVVASVLVFSLAGCGD

SEQ ID NO: 1292 - protein, 25 aa, Escherichia coli
  misc feature (1)..(25): Escherichia coli (strain K12) P37652 BCSB ECOLI
MKRKLFWICAVAMGMSAFPSFMTQA

SEQ ID NO: 1293 - protein, 25 aa, Escherichia coli
  misc feature (1)..(25): Escherichia coli O6 P0ABF5 EUTM ECOL6
MEALGMIETRGLVALIEASDAMVKA

SEQ ID NO: 1294 - protein, 25 aa, Escherichia coli
  misc feature (1)..(25): Escherichia coli (strain K12) P0AD14 YEHU ECOLI
MYDFNLVLLLLQQMCVFLVIAWLMS

SEQ ID NO: 1295 - protein, 25 aa, Escherichia coli
  misc feature (1)..(25): Escherichia coli (strain ATCC 8739/DSM 1576/Crooks) B1IPW1 B1IPW1 ECOLC
MKLNIFTKSMIGMGLVCSALPALAM

SEQ ID NO: 1296 - protein, 25 aa, Escherichia coli
  misc feature (1)..(25): Escherichia coli (strain ATCC 8739/DSM 1576/Crooks) B1IUH7 B1IUH7 ECOLC
MRWPAMMRLTCIGILAQFALLLLAF

SEQ ID NO: 1297 - protein, 25 aa, Escherichia coli
  misc feature (1)..(25): Escherichia coli (strain ATCC 8739/DSM 1576/Crooks) B1IPT3 B1IPT3 ECOLC
MNNMLKSVISAATLSLCLLTPAHAE

SEQ ID NO: 1298 - protein, 25 aa, Escherichia coli
  misc feature (1)..(25): Escherichia coli (strain K12) P0AE22 APHA ECOLI
MRKITQAISAVCLLFALNSSAVALA

SEQ ID NO: 1299 - protein, 25 aa, Escherichia coli
  misc feature (1)..(25): Escherichia coli (strain ATCC 8739/DSM 1576/Crooks) B1ISM6 B1ISM6 ECOLC
MKRNPLVVCLLIICITILTFTLLTR

SEQ ID NO: 1300 - protein, 25 aa, Escherichia coli
  misc feature (1)..(25): Escherichia coli (strain K12) P45523 FKBA ECOLI
MKSLFKVTLLATTMAVALHAPITFA

SEQ ID NO: 1301 - protein, 25 aa, Escherichia coli
  misc feature (1)..(25): Escherichia coli (strain K12) P0ACW2 YDBJ ECOLI
MRAAFWVGCAALLLSACSSEPVQQA

SEQ ID NO: 1302 - protein, 25 aa, Escherichia coli
  misc feature (1)..(25): Escherichia coli (strain ATCC 8739/DSM 1576/Crooks) B1IUL5 LAMB ECOLC
MMITLRKLPLAVAVAAGVMSAQAMA

SEQ ID NO: 1303 - protein, 25 aa, Escherichia coli
  misc feature (1)..(25): Escherichia coli Q46679 Q46679 ECOLX
MIEMNKVIAVSALAMAGMFSTQALA

SEQ ID NO: 1304 - protein, 25 aa, Escherichia coli
  misc feature (1)..(25): Escherichia coli (strain ATCC 8739/DSM 1576/Crooks) B1IU34 B1IU34 ECOLC
MTSRFMLIFAAISGFIFVALGAFGA

SEQ ID NO: 1305 - protein, 25 aa, Escherichia coli
  misc feature (1)..(25): Escherichia coli (strain ATCC 8739/DSM 1576/Crooks) B1IT31 B1IT31 ECOLC
MRKSVIAIIIIVLVVLYMSVFVVKE

SEQ ID NO: 1306 - protein, 25 aa, Escherichia coli
  misc feature (1)..(25): Escherichia coli (strain ATCC 8739/DSM 1576/Crooks) B1J048 B1J048 ECOLC
MTHQLRSRDIIALGFMTFALFVGAG

SEQ ID NO: 1307 - protein, 25 aa, Escherichia coli
  misc feature (1)..(25): Escherichia coli (strain ATCC 8739/DSM 1576/Crooks) B1IUU3 B1IUU3 ECOLC
MKTGSEFHVGIVGLGSMGMGAALSC

SEQ ID NO: 1308 - protein, 25 aa, Escherichia coli
  misc feature (1)..(25): Escherichia coli O6 P65764 FKBA ECOL6
MKSLFKVTLLATTMAVALHAPITFA

SEQ ID NO: 1309 - protein, 25 aa, Escherichia coli
  misc feature (1)..(25): Escherichia coli (strain K12) P0AFI5 PBP7 ECOLI
MPKFRVSLFSLALMLAVPFAPQAVA

SEQ ID NO: 1310 - protein, 25 aa, Escherichia coli
  misc feature (1)..(25): Escherichia coli (strain UTI89/UPEC) Q1R4L6 BGLH ECOUT
MFRRNIITSAILLMAPLAFSAQSLA

SEQ ID NO: 1311 - protein, 25 aa, Escherichia coli
  misc feature (1)..(25): Escherichia coli (strain K12) P18956 GGT ECOLI
MIKPTFLRRVAIAALLSGSCFSAAA

SEQ ID NO: 1312 - protein, 25 aa, Escherichia coli
  misc feature (1)..(25): Escherichia coli O1:K1/APEC A1AHQ2 BGLH ECOK1
MFRRNIITSAILLMAPLAFSAQSLA

SEQ ID NO: 1313 - protein, 25 aa, Escherichia coli
  misc feature (1)..(25): Escherichia coli (strain DH10B) B1X9U9 BGLH ECODH
MFRRNLITSAILLMAPLAFSAQSLA

SEQ ID NO: 1314 - protein, 25 aa, Escherichia coli
  misc feature (1)..(25): Escherichia coli (strain ATCC 8739/DSM 1576/Crooks) B1IYA6 B1IYA6 ECOLC
MDIMRSVVGMVVLLAIAFLLSVNKK

SEQ ID NO: 1315 - protein, 25 aa, Escherichia coli
  misc feature (1)..(25): Escherichia coli (strain UTI89/UPEC) Q1R3Q0 LAMB ECOUT
MMITLRKLPLAVAVAAGVMSAQAMA

SEQ ID NO: 1316 - protein, 25 aa, Escherichia coli
  misc feature (1)..(25): Escherichia coli (strain K12) P77288 YFCV ECOLI
MSKFVKTAIAAAMVMGAFTSTATIA

SEQ ID NO: 1317 - protein, 25 aa, Escherichia coli
  misc feature (1)..(25): Escherichia coli (strain ATCC 8739/DSM 1576/Crooks) B1IPW7 B1IPW7 ECOLC
MNNEQRGVALLIVLMLLALMAALAA

SEQ ID NO: 1318 - protein, 25 aa, Escherichia coli
  misc feature (1)..(25): Escherichia coli O157:H7 Q8X5W7 LAMB ECO57
MMITLRKLPLAVAVAAGVMSAQAMA

SEQ ID NO: 1319 - protein, 25 aa, Escherichia coli
  misc feature (1)..(25): Escherichia coli (strain ATCC 8739/DSM 1576/Crooks) B1IX75 B1IX75 ECOLC
MSKKLIALCACPMGLAHTFMAAQAL

SEQ ID NO: 1320 - protein, 25 aa, Escherichia coli
  misc feature (1)..(25): Escherichia coli O6:K15:H31 (strain 536/UPEC) Q0TAY9 BGLH ECOL5
MFRRNIITSAILLMAPLAFSAQSLA

SEQ ID NO: 1321 - protein, 25 aa, Escherichia coli
  misc feature (1)..(25): Escherichia coli (strain ATCC 8739/DSM 1576/Crooks) B1IPA9 B1IPA9 ECOLC
MSAKHPVIAVTGSSGAGTTTTSLAF

SEQ ID NO: 1322 - protein, 25 aa, Escherichia coli
  misc feature (1)..(25): Escherichia coli (strain K12) P28721 GLTF ECOLI
MFFKKNLTTAAICAALSVAAFSAMA

SEQ ID NO: 1323 - protein, 25 aa, Escherichia coli
  misc feature (1)..(25): Escherichia coli P14542 IUTA ECOLX
MMISKKYTLWALNPLLLTMMAPAVA

SEQ ID NO: 1324 - protein, 25 aa, Escherichia coli
  misc feature (1)..(25): Escherichia coli (strain K12) P16700 CYSP ECOLI
MAVNLLKKNSLALVASLLLAGHVQA

SEQ ID NO: 1325 - protein, 25 aa, Escherichia coli
  misc feature (1)..(25): Escherichia coli (strain K12) P0ADA3 NLPD ECOLI
MSAGSPKFTVRRIAALSLVSLWLAG

SEQ ID NO: 1326 - protein, 25 aa, Escherichia coli
  misc feature (1)..(25): Escherichia coli O9:H4 (strain HS) A8A7D6 LAMB ECOHS
MMITLRKLPLAVAVAAGVMSAQAMA

SEQ ID NO: 1327 - protein, 25 aa, Escherichia coli
  misc feature (1)..(25): Escherichia coli (strain ATCC 8739/DSM 1576/Crooks) B1IXB8 B1IXB8 ECOLC
METFNSLFMVSPLLLGVLFFVAMLA

SEQ ID NO: 1328 - protein, 25 aa, Escherichia coli
  misc feature (1)..(25): Escherichia coli O6 Q8CVU7 FADL ECOL6
MSQKTLFTKSALAVAVALISTQAWS

SEQ ID NO: 1329 - protein, 25 aa, Escherichia coli
  misc feature (1)..(25): Escherichia coli O157:H7 Q8X5L8 BCSB ECO57
MKRKLFWICAVAMGMSAFPSFMTQA

SEQ ID NO: 1330 - protein, 25 aa, Escherichia coli
  misc feature (1)..(25): Escherichia coli O6 P0AD15 YEHU ECOL6
MYDFNLVLLLLQQMCVFLVIAWLMS

SEQ ID NO: 1331 - protein, 25 aa, Escherichia coli
  misc feature (1)..(25): Escherichia coli (strain ATCC 8739/DSM 1576/Crooks) B1IZ56 B1IZ56 ECOLC
MKKVAIVGLGWLGMPLAMSLSARGW

SEQ ID NO: 1332 - protein, 25 aa, Escherichia coli
  misc feature (1)..(25): Escherichia coli (strain ATCC 8739/DSM 1576/Crooks) B1IRC2 B1IRC2 ECOLC
MKKRIPTLLATMIATALYSQQGLAA

SEQ ID NO: 1333 - protein, 25 aa, Escherichia coli
  misc feature (1)..(25): Escherichia coli Q46760 Q46760 ECOLX
MIEMKKVIAVSALAMAGMFSAQALA

SEQ ID NO: 1334 - protein, 25 aa, Escherichia coli
  misc feature (1)..(25): Escherichia coli (strain ATCC 8739/DSM 1576/Crooks) B1IS87 B1IS87 ECOLC
MPRFFARHAATLFFPMALILYDFAA

SEQ ID NO: 1335 - protein, 25 aa, Escherichia coli
  misc feature (1)..(25): Escherichia coli (strain ATCC 8739/DSM 1576/Crooks) B1IUA7 B1IUA7 ECOLC
MLRFLNQCSQGRGAWLLMAFTALAL

SEQ ID NO: 1336 - protein, 25 aa, Escherichia coli
  misc feature (1)..(25): Escherichia coli (strain ATCC 8739/DSM 1576/Crooks) B1IXX3 B1IXX3 ECOLC
MARKWLNLFAGAALSFAVAGNALAD

SEQ ID NO: 1337 - protein, 25 aa, Escherichia coli
  misc feature (1)..(25): Escherichia coli (strain ATCC 8739/DSM 1576/Crooks) B1ISR3 B1ISR3 ECOLC
MRAAFWVGCAALLLSACSSEPVQQA

SEQ ID NO: 1338 - protein, 25 aa, Escherichia coli
  misc feature (1)..(25): Escherichia coli (strain K12) P02943 LAMB ECOLI
MMITLRKLPLAVAVAAGVMSAQAMA

SEQ ID NO: 1339 - protein, 25 aa, Escherichia coli
  misc feature (1)..(25): Escherichia coli (strain ATCC 8739/DSM 1576/Crooks) B1IQC3 B1IQC3 ECOLC
MLKTIRKHGITLALFAAGSTGLTAA

SEQ ID NO: 1340 - protein, 25 aa, Escherichia coli
  misc feature (1)..(25): Escherichia coli O6 Q8CVJ9 BGLH ECOL6
MFRRNIITSAILLMAPLAFSAQSLA

SEQ ID NO: 1341 - protein, 25 aa, Escherichia coli
  misc feature (1)..(25): Escherichia coli (strain ATCC 8739/DSM 1576/Crooks) B1IRV6 B1IRV6 ECOLC
MGKTISIKVLFGIYLLLMAGKVFAF

SEQ ID NO: 1342 - protein, 25 aa, Escherichia coli
  misc feature (1)..(25): Escherichia coli (strain ATCC 8739/DSM 1576/Crooks) B1J0A6 B1J0A6 ECOLC
MQGTKIRLLAGGLLMMATAGYVQAD

SEQ ID NO: 1343 - protein, 25 aa, Escherichia coli
  misc feature (1)..(25): Escherichia coli (strain ATCC 8739/DSM 1576/Crooks) B1J0I8 B1J0I8 ECOLC
MRLLILTLSLITLAGCTVTRQAHVS

SEQ ID NO: 1344 - protein, 25 aa, Escherichia coli
  misc feature (1)..(25): Escherichia coli O139:H28 (strain E24377A/ETEC) A7ZUQ8 LAMB ECO24
MMITLRKLPLAVAVAAGVMSAQAMA

SEQ ID NO: 1345 - protein, 25 aa, Escherichia coli
  misc feature (1)..(25): Escherichia coli (strain ATCC 8739/DSM 1576/Crooks) B1ISQ9 B1ISQ9 ECOLC
MKILLAALTSSFMLVGCTPRIEVAA

SEQ ID NO: 1346 - protein, 25 aa, Escherichia coli
  misc feature (1)..(25): Escherichia coli (strain ATCC 8739/DSM 1576/Crooks) B1IXE9 B1IXE9 ECOLC
MNMKLKTLFAAAFAVVGFCSTASAV

SEQ ID NO: 1347 - protein, 25 aa, Escherichia coli
  misc feature (1)..(25): Escherichia coli (strain ATCC 8739/DSM 1576/Crooks) B1J0Y4 B1J0Y4 ECOLC
MSNLNPCMTCGACCAFFRVSFYWAE

SEQ ID NO: 1348 - protein, 25 aa, Escherichia coli
  misc feature (1)..(25): Escherichia coli (strain ATCC 8739/DSM 1576/Crooks) B1IUT9 B1IUT9 ECOLC
MSTITLLCIALTGVIMLLLLVIKAK

SEQ ID NO: 1349 - protein, 25 aa, Escherichia coli
  misc feature (1)..(25): Escherichia coli (strain ATCC 8739/DSM 1576/Crooks) B1IZD1 B1IZD1 ECOLC
MNKNRGFTPLAVVLMLSGSLALTGC

SEQ ID NO: 1350 - protein, 25 aa, Escherichia coli
  misc feature (1)..(25): Escherichia coli (strain K12) P09394 GLPQ ECOLI
MKLTLKNLSMAIMMSTIVMGSSAMA

SEQ ID NO: 1351 - protein, 25 aa, Escherichia coli
  misc feature (1)..(25): Escherichia coli (strain ATCC 8739/DSM 1576/Crooks) B1IXY3 B1IXY3 ECOLC
MKMTKLATLFLTATLSLASGAALAA

SEQ ID NO: 1352 - protein, 25 aa, Escherichia coli
  misc feature (1)..(25): Escherichia coli (strain K12) P10384 FADL ECOLI
MSQKTLFTKSALAVAVALISTQAWS

SEQ ID NO: 1353 - protein, 25 aa, Escherichia coli
  misc feature (1)..(25): Escherichia coli O157:H7 Q8XCN6 FADL ECO57
MSQKTLFTKSALAVAVALISTQAWS

SEQ ID NO: 1354 - protein, 25 aa, Escherichia coli
  misc feature (1)..(25): Escherichia coli (strain ATCC 8739/DSM 1576/Crooks) B1IZL4 B1IZL4 ECOLC
MKLRSVTYALFIAGLAAFSTSSLAA

SEQ ID NO: 1355 - protein, 25 aa, Escherichia coli
  misc feature (1)..(25): Escherichia coli (strain ATCC 8739/DSM 1576/Crooks) B1IS20 B1IS20 ECOLC
MRIGMRLLLGYFLLVAVAAWFVLAI

SEQ ID NO: 1356 - protein, 25 aa, Escherichia coli
  misc feature (1)..(25): Escherichia coli (strain ATCC 8739/DSM 1576/Crooks) B1IX85 B1IX85 ECOLC
MIYLWMFLALCIVCVSGYIGQVLNV

SEQ ID NO: 1357 - protein, 25 aa, Escherichia coli
  misc feature (1)..(25): Escherichia coli (strain ATCC 8739/DSM 1576/Crooks) B1IQA8 B1IQA8 ECOLC
MNGGPMKRFSLAILALVVATGAQAA

SEQ ID NO: 1358 - protein, 25 aa, Escherichia coli
  misc feature (1)..(25): Escherichia coli (strain ATCC 8739/DSM 1576/Crooks) B1IWE9 B1IWE9 ECOLC
MQLRKLLLPGLLSVTLLSGCSLFNS

SEQ ID NO: 1359 - protein, 25 aa, Escherichia coli
  misc feature (1)..(25): Escherichia coli (strain ATCC 8739/DSM 1576/Crooks) B1IRN8 B1IRN8 ECOLC
MKLITAPCRALLALPFCYAFSAAGE

SEQ ID NO: 1360 - protein, 25 aa, Escherichia coli
  misc feature (1)..(25): Escherichia coli (strain ATCC 8739/DSM 1576/Crooks) B1J070 B1J070 ECOLC
MSRVNPLSSLSLLAVLVLAGCSSQA

SEQ ID NO: 1361 - protein, 25 aa, Escherichia coli
  misc feature (1)..(25): Escherichia coli (strain ATCC 8739/DSM 1576/Crooks) B1IY39 B1IY39 ECOLC
MKTNRSLVVIVSLITATLLLTACAQ

SEQ ID NO: 1362 - protein, 25 aa, Escherichia coli
  misc feature (1)..(25): Escherichia coli (strain K12) P77616 YQIH ECOLI
MRYLNTKNIIAAGVLLSCMSSIAWG

SEQ ID NO: 1363 - protein, 25 aa, Escherichia coli
  misc feature (1)..(25): Escherichia coli (strain ATCC 8739/DSM 1576/Crooks) B1IPE3 B1IPE3 ECOLC
MFDVTLLILLGLAALGFISHNTTVA

SEQ ID NO: 1364 - protein, 25 aa, Escherichia coli
  misc feature (1)..(25): Escherichia coli (strain ATCC 8739/DSM 1576/Crooks) B1IR66 B1IR66 ECOLC
MRKVCAAILSAAICLAVSGAPAWAS

SEQ ID NO: 1365 - protein, 25 aa, Escherichia coli
  misc feature (1)..(25): Escherichia coli O6:K15:H31 (strain 536/UPEC) Q0TA25 LAMB ECOL5
MMITLRKLPLAVAVAAGVMSAQAMA

SEQ ID NO: 1366 - protein, 25 aa, Escherichia coli
  misc feature (1)..(25): Escherichia coli O1:K1/APEC A1AIL4 LAMB ECOK1
MMITLRKLPLAVAVAAGVMSAQAMA

SEQ ID NO: 1367 - protein, 25 aa, Escherichia coli
  misc feature (1)..(25): Escherichia coli O6 P0ACW3 YDBJ ECOL6
MRAAFWVGCAALLLSACSSEPVQQA

SEQ ID NO: 1368 - protein, 25 aa, Escherichia coli
  misc feature (1)..(25): Escherichia coli O6 Q8CVR2 NANM1 ECOL6
MITMKVKNFIYLPFCLFIGTSVAGA

SEQ ID NO: 1369 - protein, 25 aa, Escherichia coli
  misc feature (1)..(25): Escherichia coli (strain ATCC 8739/DSM 1576/Crooks) B1IUS6 B1IUS6 ECOLC
MFSALRHRTAALALGVCFILPVHAS

SEQ ID NO: 1370 - protein, 25 aa, Escherichia coli
  misc feature (1)..(25): Escherichia coli (strain K12) P0AAR8 YBAV ECOLI
MKHGIKALLITLSLACAGMSHSALA

SEQ ID NO: 1371 - protein, 25 aa, Escherichia coli
  misc feature (1)..(25): Escherichia coli (strain K12) P07024 USHA ECOLI
MKLLQRGVALALLTTFTLASETALA

SEQ ID NO: 1372 - protein, 25 aa, Escherichia coli
  misc feature (1)..(25): Escherichia coli (strain K12) Q46798 YGER ECOLI
MSAGRLNKKSLGIVMLLSVGLLLAG

SEQ ID NO: 1373 - protein, 25 aa, Escherichia coli
  misc feature (1)..(25): Escherichia coli (strain K12) P33128 ECPD ECOLI
MFFNTKHTTALCFVTCMAFSSSSIA

SEQ ID NO: 1374 - protein, 25 aa, Escherichia coli
  misc feature (1)..(25): Escherichia coli (strain K12) P42914 YRAI ECOLI
MSKRTFAVILTLLCSFCIGQALAGG

SEQ ID NO: 1375 - protein, 25 aa, Escherichia coli
  misc feature (1)..(25): Escherichia coli O157:H7 P65765 FKBA ECO57
MKSLFKVTLLATTMAVALHAPITFA

SEQ ID NO: 1376 - protein, 25 aa, Escherichia coli
  misc feature (1)..(25): Escherichia coli O9:H4 (strain HS) A8A6I1 BGLH ECOHS
MFRRNLITSAILLMAPLAFSAQSLA

SEQ ID NO: 1377 - protein, 25 aa, Escherichia coli
  misc feature (1)..(25): Escherichia coli (strain ATCC 8739/DSM 1576/Crooks) B1IQL8 B1IQL8 ECOLC
MKTFFRTVLFGSLMAVCANSYALSE

SEQ ID NO: 1378 - protein, 25 aa, Escherichia coli
  misc feature (1)..(25): Escherichia coli (strain ATCC 8739/DSM 1576/Crooks) B1IYX9 B1IYX9 ECOLC
MQLRITSRKKLTSLLCALGLISIVA

SEQ ID NO: 1379 - protein, 25 aa, Escherichia coli
  misc feature (1)..(25): Escherichia coli (strain K12) P36943 EAEH ECOLI
MSHYKTGHKQPRFRYSVLARCVAWA

SEQ ID NO: 1380 - protein, 25 aa, Escherichia coli
  misc feature (1)..(25): Escherichia coli (strain K12) P0AG82 PSTS ECOLI
MKVMRTTVATVVAATLSMSAFSVFA

SEQ ID NO: 1381 - protein, 25 aa, Escherichia coli
  misc feature (1)..(25): Escherichia coli (strain K12) P26218 BGLH ECOLI
MFRRNLITSAILLMAPLAFSAQSLA

SEQ ID NO: 1382 - protein, 25 aa, Escherichia coli
  misc feature (1)..(25): Escherichia coli (strain ATCC 8739/DSM 1576/Crooks) B1IX18 BGLH ECOLC
MFRRNLITSAILLMAPLAFSAQSLA

SEQ ID NO: 1383 - protein, 25 aa, Escherichia coli
  misc feature (1)..(25): Escherichia coli (strain ATCC 8739/DSM 1576/Crooks) B1IU88 B1IU88 ECOLC
MKRKNASLLGNVLMGLGLVVMVVGV

SEQ ID NO: 1384 - protein, 25 aa, Escherichia coli
  misc feature (1)..(25): Escherichia coli (strain ATCC 8739/DSM 1576/Crooks) B1IPM0 B1IPM0 ECOLC
MSFQFCRRKFYFLLALALPGYAAVH

SEQ ID NO: 1385 - protein, 25 aa, Escherichia coli
  misc feature (1)..(25): Escherichia coli O6 Q8CVI4 LAMB ECOL6
MMITLRKLPLAVAVAAGVMSAQAMA

SEQ ID NO: 1386 - protein, 25 aa, Escherichia coli
  misc feature (1)..(25): Escherichia coli (strain ATCC 8739/DSM 1576/Crooks) B1ITQ0 B1ITQ0 ECOLC
MMKRLIVLVLLASTLLTGCNTARGF

SEQ ID NO: 1387 - protein, 25 aa, Escherichia coli
  misc feature (1)..(25): Escherichia coli (strain ATCC 8739/DSM 1576/Crooks) B1IQ24 B1IQ24 ECOLC
MKKMMIATLAAASVLLAVANQAHAG

SEQ ID NO: 1388 - protein, 25 aa, Escherichia coli
  misc feature (1)..(25): Escherichia coli (strain ATCC 8739/DSM 1576/Crooks) B1ISL6 B1ISL6 ECOLC
MRTTSFAKVAALCGLLALSGCASKI

SEQ ID NO: 1389 - protein, 25 aa, Escherichia coli
  misc feature (1)..(25): Escherichia coli (strain K12) P0ABF4 EUTM ECOLI
MEALGMIETRGLVALIEASDAMVKA

SEQ ID NO: 1390 - protein, 25 aa, Escherichia coli
  misc feature (1)..(25): Escherichia coli (strain K12) P02925 RBSB ECOLI
MNMKKLATLVSAVALSATVSANAMA

SEQ ID NO: 1391 - protein, 25 aa, Escherichia coli
  misc feature (1)..(25): Escherichia coli (strain ATCC 8739/DSM 1576/Crooks) B1IRS6 B1IRS6 ECOLC
MNLSLRRSTSALLASSLLLTIGRGA

SEQ ID NO: 1392 - protein, 25 aa, Escherichia coli
  misc feature (1)..(25): Escherichia coli (strain ATCC 8739/DSM 1576/Crooks) B1IP69 B1IP69 ECOLC
MKFVKYFLILAVCCILLGAGSIYGL

SEQ ID NO: 1393 - protein, 25 aa, Escherichia coli
  misc feature (1)..(25): Escherichia coli (strain K12) P18390 YJJA ECOLI
MMKTVKHLLCCAIAASALISTGVHA

SEQ ID NO: 1394 - protein, 25 aa, Escherichia coli
  misc feature (1)..(25): Escherichia coli (strain ATCC 8739/DSM 1576/Crooks) B1IW81 B1IW81 ECOLC
MTLEWWFAYLLTSIILSLSPGSGAI

SEQ ID NO: 1395 - protein, 25 aa, Escherichia coli
  misc feature (1)..(25): Escherichia coli O139:H28 (strain E24377A/ETEC) A7ZTS5 BGLH ECO24
MFRRNLITSAILLMAPLAFSAQSLA

SEQ ID NO: 1396 - protein, 25 aa, Escherichia coli
  misc feature (1)..(25): Escherichia coli (strain K12) P17315 CIRA ECOLI
MFRLNPFVRVGLCLSAISCAWPVLA

SEQ ID NO: 1397 - protein, 25 aa, Escherichia coli
  misc feature (1)..(25): Escherichia coli (strain ATCC 8739/DSM 1576/Crooks) B1IVU7 B1IVU7 ECOLC
MRPLILSIFALFLAGCTHSQQSMVD

SEQ ID NO: 1398 - protein, 25 aa, Escherichia coli
  misc feature (1)..(25): Escherichia coli (strain ATCC 8739/DSM 1576/Crooks) B1ISN8 B1ISN8 ECOLC
MFKARICGWIGLLPLFMLSLPVQAE

SEQ ID NO: 1399 - protein, 25 aa, Escherichia coli
  misc feature (1)..(25): Escherichia coli (strain ATCC 8739/DSM 1576/Crooks) B1IY11 B1IY11 ECOLC
MDTVNIYRLSFVSCLVVAMPCALAV

SEQ ID NO: 1400 - protein, 25 aa, Escherichia coli
  misc feature (1)..(25): Escherichia coli (strain K12) P76128 DDPA ECOLI
MKRSISFRPTLLALVLATNFPVAHA

SEQ ID NO: 1401 - protein, 25 aa, Escherichia coli
  misc feature (1)..(25): Escherichia coli (strain ATCC 8739/DSM 1576/Crooks) B1IVP1 B1IVP1 ECOLC
MRILFVCSLLLLSGCSHMANDSWSG

SEQ ID NO: 1402 - protein, 25 aa, Escherichia coli
  misc feature (1)..(25): Escherichia coli (strain ATCC 8739/DSM 1576/Crooks) B1IYM6 B1IYM6 ECOLC
MLTKYALAAVIVLCLTVLGFTLLVG

SEQ ID NO: 1403 - protein, 26 aa, Escherichia coli
  misc feature (1)..(26): Escherichia coli (strain ATCC 8739/DSM 1576/Crooks) B1IYB4 B1IYB4 ECOLC
MFRLNPFVRVGLCLSAISCAWPVLAV

SEQ ID NO: 1404 - protein, 26 aa, Escherichia coli
  misc feature (1)..(26): Escherichia coli (strain ATCC 8739/DSM 1576/Crooks) B1IT95 B1IT95 ECOLC
MSVIIVGGGMAGATLALAISRLSHGA

SEQ ID NO: 1405 - protein, 26 aa, Escherichia coli
  misc feature (1)..(26): Escherichia coli O1:K1/APEC A1A9S2 YCDO ECOK1
MTINFRRNALQLSVAALFSSAFMANA

SEQ ID NO: 1406 - protein, 26 aa, Escherichia coli
  misc feature (1)..(26): Escherichia coli O6 Q8CVI9 ZRAP ECOL6
MKRNTKIALVMMALSAMAMGSTSAFA

SEQ ID NO: 1407 - protein, 26 aa, Escherichia coli
  misc feature (1)..(26): Escherichia coli (strain K12) P0ADM4 YIDQ ECOLI
MIRNVLLAFMICSGMTLLGGCSSVMS

SEQ ID NO: 1408 - protein, 26 aa, Escherichia coli
  misc feature (1)..(26): Escherichia coli Q47389 Q47389 ECOLX
MKIKTGARILALSALKTMMFSASALA

SEQ ID NO: 1409 - protein, 26 aa, Escherichia coli
  misc feature (1)..(26): Escherichia coli (strain ATCC 8739/DSM 1576/Crooks) B1IRU4 LSRB ECOLC
MTLHRFKKIALLSVLGIAAISMNVQA

SEQ ID NO: 1410 - protein, 26 aa, Escherichia coli
  misc feature (1)..(26): Escherichia coli (strain ATCC 8739/DSM 1576/Crooks) B1J0I3 B1J0I3 ECOLC
MIKPTFLRRVAIAALLSGSCFSAAAA

SEQ ID NO: 1411 - protein, 26 aa, Escherichia coli
  misc feature (1)..(26): Escherichia coli O6 P0AFV5 SPR ECOL6
MVKSQPILRYILRGIPAIAVAVLLSA

SEQ ID NO: 1412 - protein, 26 aa, Escherichia coli
  misc feature (1)..(26): Escherichia coli O139:H28 (strain E24377A/ETEC) A7ZLX3 LSRB ECO24
MTLHRFKKIALLSALGIAAISMNVQA

SEQ ID NO: 1413 - protein, 26 aa, Escherichia coli
  misc feature (1)..(26): Escherichia coli (strain UTI89/UPEC) Q1R3H8 YTCA ECOUT
MPTVLSRMAMQLKKTAWIIPVFMVSG

SEQ ID NO: 1414 - protein, 26 aa, Escherichia coli
  misc feature (1)..(26): Escherichia coli O157:H7 Q8XAY9 LSRB ECO57
MTLHRFKKIALLSALGIAAISMNVQA

SEQ ID NO: 1415 - protein, 26 aa, Escherichia coli
  misc feature (1)..(26): Escherichia coli (strain K12) P23843 OPPA ECOLI
MTNITKRSLVAAGVLAALMAGNVALA

SEQ ID NO: 1416 - protein, 26 aa, Escherichia coli
  misc feature (1)..(26): Escherichia coli O157:H7 P0AFV6 SPR ECO57
MVKSQPILRYILRGIPAIAVAVLLSA

SEQ ID NO: 1417 - protein, 26 aa, Escherichia coli
  misc feature (1)..(26): Escherichia coli O6 Q8FAX0 YTCA ECOL6
MPTVLSRMAMQLKKTAWIIPVFMVSG

SEQ ID NO: 1418 - protein, 26 aa, Escherichia coli
  misc feature (1)..(26): Escherichia coli (strain ATCC 8739/DSM 1576/Crooks) B1ISY0 B1ISY0 ECOLC
MSLWKKISLGVVIVILLLLGSVAFLV

SEQ ID NO: 1419 - protein, 26 aa, Escherichia coli
  misc feature (1)..(26): Escherichia coli (strain ATCC 8739/DSM 1576/Crooks) B1IQK2 B1IQK2 ECOLC
MEHSMKRIIIISTLVGLGLPTTGSAT

SEQ ID NO: 1420 - protein, 26 aa, Escherichia coli
  misc feature (1)..(26): Escherichia coli (strain ATCC 8739/DSM 1576/Crooks) B1IUJ6 B1IUJ6 ECOLC
MRKITQAISAVCLLFALNSSAVALAS

SEQ ID NO: 1421 - protein, 26 aa, Escherichia coli
  misc feature (1)..(26): Escherichia coli (strain ATCC 8739/DSM 1576/Crooks) B1IW22 B1IW22 ECOLC
MKNTKLLLAIATSAALLTGCQNTHGI

SEQ ID NO: 1422 - protein, 26 aa, Escherichia coli
  misc feature (1)..(26): Escherichia coli Q47118 Q47118 ECOLX
MRAFNKITVFILFIPGLCFGTNGLES

SEQ ID NO: 1423 - protein, 26 aa, Escherichia coli
  misc feature (1)..(26): Escherichia coli (strain ATCC 8739/DSM 1576/Crooks) B1IWN5 B1IWN5 ECOLC
MGTTKHSKLLILGSGPAGYTAAVYAA

SEQ ID NO: 1424 - protein, 26 aa, Escherichia coli
  misc feature (1)..(26): Escherichia coli (strain K12) P16682 PHND ECOLI
MNAKIIASLAFTSMFSLSTLLSPAHA

SEQ ID NO: 1425 - protein, 26 aa, Escherichia coli
  misc feature (1)..(26): Escherichia coli (strain K12) P76142 LSRB ECOLI
MTLHRFKKIALLSALGIAAISMNVQA

SEQ ID NO: 1426 - protein, 26 aa, Escherichia coli
  misc feature (1)..(26): Escherichia coli (strain ATCC 8739/DSM 1576/Crooks) B1IZP7 B1IZP7 ECOLC
MTPSNYQRTRWLTLIGTIITQFALGS

SEQ ID NO: 1427 - protein, 26 aa, Escherichia coli
  misc feature (1)..(26): Escherichia coli (strain K12) P31133 POTF ECOLI
MTALNKKWLSGLVAGALMAVSVGTLA

SEQ ID NO: 1428 - protein, 26 aa, Escherichia coli
  misc feature (1)..(26): Escherichia coli (strain K12) P77588 YDEQ ECOLI
MGKTISIKVLFGIYLLLMAGKVFAFS

SEQ ID NO: 1429 - protein, 26 aa, Escherichia coli
  misc feature (1)..(26): Escherichia coli O6 P0AEL7 FEPB ECOL6
MRLAPLYRNALLLTGLLLSGIAAVQA

SEQ ID NO: 1430 - protein, 26 aa, Escherichia coli
  misc feature (1)..(26): Escherichia coli (strain K12) P0AB24 YCDO ECOLI
MTINFRRNALQLSVAALFSSAFMANA

SEQ ID NO: 1431 - protein, 26 aa, Escherichia coli
  misc feature (1)..(26): Escherichia coli (strain ATCC 8739/DSM 1576/Crooks) B1IQ79 B1IQ79 ECOLC
MKATKLVLGAVILGSTLLAGCSSNAK

SEQ ID NO: 1432 - protein, 26 aa, Escherichia coli
  misc feature (1)..(26): Escherichia coli O6 P0AA58 YOBA ECOL6
MASTARSLRYALAILTTSLVTPSVWA

SEQ ID NO: 1433 - protein, 26 aa, Escherichia coli
  misc feature (1)..(26): Escherichia coli (strain ATCC 8739/DSM 1576/Crooks) B1IRR9 B1IRR9 ECOLC
MRYLNTKNIIAAGVLLSCMNSIAWGA

SEQ ID NO: 1434 - protein, 26 aa, Escherichia coli
  misc feature (1)..(26): Escherichia coli O157:H7 P0ABL0 NRFA ECO57
MTRIKINARRIFSLLIPFFFFTSVHA

SEQ ID NO: 1435 - protein, 26 aa, Escherichia coli
  misc feature (1)..(26): Escherichia coli (strain ATCC 8739/DSM 1576/Crooks) B1IZB4 B1IZB4 ECOLC
MKLLQRGVALALLTTFTLASETALAY

SEQ ID NO: 1436 - protein, 26 aa, Escherichia coli
  misc feature (1)..(26): Escherichia coli (strain K12) P75797 GSIB ECOLI
MARAVHRSGLVALGIATALMASCAFA

SEQ ID NO: 1437 - protein, 26 aa, Escherichia coli
  misc feature (1)..(26): Escherichia coli O1:K1/APEC A1AIS9 YTCA ECOK1
MPTVLSRMAMQLKKTAWIIPVFMVSG

SEQ ID NO: 1438 - protein, 26 aa, Escherichia coli
  misc feature (1)..(26): Escherichia coli (strain K12) P0AAA9 ZRAP ECOLI
MKRNTKIALVMMALSAMAMGSTSAFA

SEQ ID NO: 1439 - protein, 26 aa, Escherichia coli
  misc feature (1)..(26): Escherichia coli (strain UTI89/UPEC) Q1R3J6 NRFA ECOUT
MTRIKINARRIFSLLIPFFFFTSVHA

SEQ ID NO: 1440 - protein, 26 aa, Escherichia coli
  misc feature (1)..(26): Escherichia coli (strain K12) P75856 YCBR ECOLI
MKTCITKGIVTVSLTAILLSCSSAWA

SEQ ID NO: 1441 - protein, 26 aa, Escherichia coli
  misc feature (1)..(26): Escherichia coli (strain K12) P0ABK9 NRFA ECOLI
MTRIKINARRIFSLLIPFFFFTSVHA

SEQ ID NO: 1442 - protein, 26 aa, Escherichia coli
  misc feature (1)..(26): Escherichia coli O139:H28 (strain E24377A/ETEC) A7ZUU5 NRFA ECO24
MTRIKINARRIFSLLIPFFFFTSVHA

SEQ ID NO: 1443 - protein, 26 aa, Escherichia coli
  misc feature (1)..(26): Escherichia coli (strain ATCC 8739/DSM 1576/Crooks) B1IPK8 B1IPK8 ECOLC
MKLLKTVPAIVMLAGGMFASLNAAAD

SEQ ID NO: 1444 - protein, 26 aa, Escherichia coli
  misc feature (1)..(26): Escherichia coli (strain ATCC 8739/DSM 1576/Crooks) B1IV64 B1IV64 ECOLC
MQRLFLLVAVMLLSGCLTAPPKEAAR

SEQ ID NO: 1445 - protein, 26 aa, Escherichia coli
  misc feature (1)..(26): Escherichia coli (strain K12) P0AEX9 MALE ECOLI
MKIKTGARILALSALTTMMFSASALA

SEQ ID NO: 1446 - protein, 26 aa, Escherichia coli
  misc feature (1)..(26): Escherichia coli (strain ATCC 8739/DSM 1576/Crooks) B1IWF6 B1IWF6 ECOLC
MKFKKCLLPVAMLASFTLAGCQSNAD

SEQ ID NO: 1447 - protein, 26 aa, Escherichia coli
  misc feature (1)..(26): Escherichia coli (strain ATCC 8739/DSM 1576/Crooks) B1J006 B1J006 ECOLC
MKHGIKALLITLSLACAGMSHSALAA

SEQ ID NO: 1448 - protein, 26 aa, Escherichia coli
  misc feature (1)..(26): Escherichia coli O6 P0ADA2 TESA ECOL6
MMNFNNVFRWHLPFLFLVLLTFRAAA

SEQ ID NO: 1449 - protein, 26 aa, Escherichia coli
  misc feature (1)..(26): Escherichia coli O157:H7 Q8XAS6 YCDO ECO57
MTINFRRNALQLSVAALFSSAFMANA

SEQ ID NO: 1450 - protein, 26 aa, Escherichia coli
  misc feature (1)..(26): Escherichia coli (strain ATCC 8739/DSM 1576/Crooks) B1IQK0 B1IQK0 ECOLC
MFPIIKKTVSALFISTLLTSAPAFAD

SEQ ID NO: 1451 - protein, 26 aa, Escherichia coli
  misc feature (1)..(26): Escherichia coli (strain K12) P0AA57 YOBA ECOLI
MASTARSLRYALAILTTSLVTPSVWA

SEQ ID NO: 1452 - protein, 26 aa, Escherichia coli
  misc feature (1)..(26): Escherichia coli (strain ATCC 8739/DSM 1576/Crooks) B1ISL4 B1ISL4 ECOLC
MRLFSIPPPTLLAGFLAVLIGYASSA

SEQ ID NO: 1453 - protein, 26 aa, Escherichia coli
  misc feature (1)..(26): Escherichia coli O1:K1/APEC A1A968 GSIB ECOK1
MARAVHRSGLVALGIATALMASCAFA

SEQ ID NO: 1454 - protein, 26 aa, Escherichia coli
  misc feature (1)..(26): Escherichia coli O6 Q8CVI1 NRFA ECOL6
MTRIKINARRIFSLLIPFFFFTSVHA

SEQ ID NO: 1455 - protein, 26 aa, Escherichia coli
  misc feature (1)..(26): Escherichia coli Q47038 AFAD ECOLX
MNGSIRKMMRVTCGMLLMVMSGVSQA

SEQ ID NO: 1456 - protein, 26 aa, Escherichia coli
  misc feature (1)..(26): Escherichia coli (strain ATCC 8739/DSM 1576/Crooks) B1IT45 B1IT45 ECOLC
MSARMFVLCCIWFIVAFLWITITSAL

SEQ ID NO: 1457 - protein, 26 aa, Escherichia coli
  misc feature (1)..(26): Escherichia coli (strain ATCC 8739/DSM 1576/Crooks) B1IXB0 B1IXB0 ECOLC
MSHKFLAGAGLLVLAGWGVSGLAVAG

SEQ ID NO: 1458 - protein, 26 aa, Escherichia coli
  misc feature (1)..(26): Escherichia coli (strain SMS-3-5/SECEC) B1LF99 LSRB ECOSM
MTLHRFKKIALLSALGIAAISMNVQA

SEQ ID NO: 1459 - protein, 26 aa, Escherichia coli
  misc feature (1)..(26): Escherichia coli (strain ATCC 8739/DSM 1576/Crooks) B1IYT0 B1IYT0 ECOLC
MGSTRKGMLNVLIAAVLWGSSGVCAQ

SEQ ID NO: 1460 - protein, 26 aa, Escherichia coli
  misc feature (1)..(26): Escherichia coli (strain ATCC 8739/DSM 1576/Crooks) B1IXU9 B1IXU9 ECOLC
MKLKLKNLSMAIMMSTIVMGSSAMAA

SEQ ID NO: 1461 - protein, 26 aa, Escherichia coli
  misc feature (1)..(26): Escherichia coli (strain ATCC 8739/DSM 1576/Crooks) B1ITH1 B1ITH1 ECOLC
MFVTSKKMTAAVLAITLAMSLSACSN

SEQ ID NO: 1462 - protein, 26 aa, Escherichia coli
  misc feature (1)..(26): Escherichia coli O6 Q8FJ35 YCDO ECOL6
MTINFRRNALQLSVAALFSSAFMANA

SEQ ID NO: 1463 - protein, 26 aa, Escherichia coli
  misc feature (1)..(26): Escherichia coli (strain K12) P0ADA1 TESA ECOLI
MMNFNNVFRWHLPFLFLVLLTFRAAA

SEQ ID NO: 1464 - protein, 26 aa, Escherichia coli
  misc feature (1)..(26): Escherichia coli O157:H7 Q8X2V8 YTCA ECO57
MPTVLSRMAMQLKKTAWIIPVFMVSG

SEQ ID NO: 1465 - protein, 26 aa, Escherichia coli
  misc feature (1)..(26): Escherichia coli (strain ATCC 8739/DSM 1576/Crooks) B1IPR1 B1IPR1 ECOLC
MRMKRNLKAIPVLVAGLFTSQLSIAA

SEQ ID NO: 1466 - protein, 26 aa, Escherichia coli
  misc feature (1)..(26): Escherichia coli (strain K12) P77269 YPHF ECOLI
MPTKMRTTRNLLLMATLLGSALFARA

SEQ ID NO: 1467 - protein, 26 aa, Escherichia coli
  misc feature (1)..(26): Escherichia coli (strain ATCC 8739/DSM 1576/Crooks) B1IX47 B1IX47 ECOLC
MAVNLLKKNSLALVASLLLAGHVQAT

SEQ ID NO: 1468 - protein, 26 aa, Escherichia coli
  misc feature (1)..(26): Escherichia coli (strain K12) A5A630 YTCA ECOLI
MPTVLSRMAMQLKKTAWIIPVFMVSG

SEQ ID NO: 1469 - protein, 26 aa, Escherichia coli
  misc feature (1)..(26): Escherichia coli (strain K12) P45955 YBGF ECOLI
MSSNFRHQLLSLSLLVGIAAPWAAFA

SEQ ID NO: 1470 - protein, 26 aa, Escherichia coli
  misc feature (1)..(26): Escherichia coli (strain ATCC 8739/DSM 1576/Crooks) B1IWY7 B1IWY7 ECOLC
MNMKKLATLVSAVALSATVSANAMAK

SEQ ID NO: 1471 - protein, 26 aa, Escherichia coli
  misc feature (1)..(26): Escherichia coli (strain DH10B) B1XEA4 LSRB ECODH
MTLHRFKKIALLSALGIAAISMNVQA

SEQ ID NO: 1472 - protein, 26 aa, Escherichia coli
  misc feature (1)..(26): Escherichia coli (strain ATCC 8739/DSM 1576/Crooks) B1IXA7 B1IXA7 ECOLC
MSKFVKTAIAAAMVMGVFTSTATIAA

SEQ ID NO: 1473 - protein, 26 aa, Escherichia coli
  misc feature (1)..(26): Escherichia coli (strain ATCC 8739/DSM 1576/Crooks) B1IQ40 B1IQ40 ECOLC
MRLTTKFSAFVTLLTGLTIFVTLLGC

SEQ ID NO: 1474 - protein, 26 aa, Escherichia coli
  misc feature (1)..(26): Escherichia coli O157:H7 P69435 PGAA ECO57
MYSSSRKRCPKTKWALKLLTAAFLAA

SEQ ID NO: 1475 - protein, 26 aa, Escherichia coli
  misc feature (1)..(26): Escherichia coli O157:H7 Q8X6V9 GSIB ECO57
MARAVHRSGLVALGIATALMASCAFA

SEQ ID NO: 1476 - protein, 26 aa, Escherichia coli
  misc feature (1)..(26): Escherichia coli (strain ATCC 8739/DSM 1576/Crooks) B1IUZ3 B1IUZ3 ECOLC
MTKPNHELSPALIVLMSIATGLAVAS

SEQ ID NO: 1477 - protein, 26 aa, Escherichia coli
  misc feature (1)..(26): Escherichia coli (strain UTI89/UPEC) Q1RDJ9 YCDO ECOUT
MTINFRRNALQLSVAALFSSAFMANA

SEQ ID NO: 1478 - protein, 26 aa, Escherichia coli
  misc feature (1)..(26): Escherichia coli (strain K12) P69434 PGAA ECOLI
MYSSSRKRCPKTKWALKLLTAAFLAA

SEQ ID NO: 1479 - protein, 26 aa, Escherichia coli
  misc feature (1)..(26): Escherichia coli O6:K15:H31 (strain 536/UPEC) Q0T9X8 NRFA ECOL5
MTRIKINARRIFSLLIPFFFFTSVHA

SEQ ID NO: 1480 - protein, 26 aa, Escherichia coli
  misc feature (1)..(26): Escherichia coli (strain ATCC 8739/DSM 1576/Crooks) B1IX10 B1IX10 ECOLC
MKVMRTTVATVVAATLSMSAFSVFAE

SEQ ID NO: 1481 - protein, 26 aa, Escherichia coli
  misc feature (1)..(26): Escherichia coli (strain ATCC 8739/DSM 1576/Crooks) B1IPB8 B1IPB8 ECOLC
MKSLFKVTLLATTMAVALHAPITFAA

SEQ ID NO: 1482 - protein, 26 aa, Escherichia coli
  misc feature (1)..(26): Escherichia coli Q47304 Q47304 ECOLX
MSDIVYMGNKALYLILIFSLWPVGIA

SEQ ID NO: 1483 - protein, 26 aa, Escherichia coli
  misc feature (1)..(26): Escherichia coli (strain ATCC 8739/DSM 1576/Crooks) B1IQE8 B1IQE8 ECOLC
MVKKAIVTAMAVISLFTLMGCNNRAE

SEQ ID NO: 1484 - protein, 26 aa, Escherichia coli
  misc feature (1)..(26): Escherichia coli (strain ATCC 8739/DSM 1576/Crooks) B1IUM0 B1IUM0 ECOLC
MNTQYNSSYIFSITLVATLGGLLFGY

SEQ ID NO: 1485 - protein, 26 aa, Escherichia coli
  misc feature (1)..(26): Escherichia coli (strain ATCC 8739/DSM 1576/Crooks) B1IT00 B1IT00 ECOLC
MRNIIRSINALLAALNITILAIIVAC

SEQ ID NO: 1486 - protein, 26 aa, Escherichia coli
  misc feature (1)..(26): Escherichia coli (strain ATCC 8739/DSM 1576/Crooks) B1IY87 B1IY87 ECOLC
MTTRQHSSFAIVFILGLLAMLMPLSI

SEQ ID NO: 1487 - protein, 26 aa, Escherichia coli
  misc feature (1)..(26): Escherichia coli P06875 PAC ECOLX
MKNRNRMIVNCVTASLMYYWSLPALA

SEQ ID NO: 1488 - protein, 26 aa, Escherichia coli
  misc feature (1)..(26): Escherichia coli O157:H7 P0AEY0 MALE ECO57
MKIKTGARILALSALTTMMFSASALA

SEQ ID NO: 1489 - protein, 26 aa, Escherichia coli
  misc feature (1)..(26): Escherichia coli (strain K12) P08370 YGDB ECOLI
MNREKGVSSLALVLMLLVLGSLLLQG

SEQ ID NO: 1490 - protein, 26 aa, Escherichia coli
  misc feature (1)..(26): Escherichia coli O9:H4 (strain HS) A8A7H1 NRFA ECOHS
MTRIKINARRIFSLLIPFFFFTSVHA

SEQ ID NO: 1491 - protein, 26 aa, Escherichia coli
  misc feature (1)..(26): Escherichia coli O157:H7 P0C0V1 DEGP ECO57
MKKTTLALSALALSLGLALSPLSATA

SEQ ID NO: 1492 - protein, 26 aa, Escherichia coli
  misc feature (1)..(26): Escherichia coli (strain K12) P34211 YUAR ECOLI
MRVIMKPLRRTLVFFIFSVFLCGTVS

SEQ ID NO: 1493 - protein, 26 aa, Escherichia coli
  misc feature (1)..(26): Escherichia coli O6:K15:H31 (strain 536/UPEC) Q0TJL8 GSIB ECOL5
MARAVHRSGLVALGIATALMASCAFA

SEQ ID NO: 1494 - protein, 26 aa, Escherichia coli
  misc feature (1)..(26): Escherichia coli (strain ATCC 8739/DSM 1576/Crooks) B1IUI1 NRFA ECOLC
MTRIKINARRIFSLLIPFFFFTSVHA

SEQ ID NO: 1495 - protein, 26 aa, Escherichia coli
  misc feature (1)..(26): Escherichia coli (strain ATCC 8739/DSM 1576/Crooks) B1IRX1 B1IRX1 ECOLC
MKRSISFRPTLLALVLATTFPVAHAA

SEQ ID NO: 1496 - protein, 26 aa, Escherichia coli
  misc feature (1)..(26): Escherichia coli (strain ATCC 8739/DSM 1576/Crooks) B1IWX9 B1IWX9 ECOLC
MTALLRVISLVVISVVVIIIPPCGAA

SEQ ID NO: 1497 - protein, 26 aa, Escherichia coli
  misc feature (1)..(26): Escherichia coli (strain ATCC 8739/DSM 1576/Crooks) B1IXA2 B1IXA2 ECOLC
MSQKTLFTKSALAVAVALISTQAWSA

SEQ ID NO: 1498 - protein, 26 aa, Escherichia coli
  misc feature (1)..(26): Escherichia coli P33784 FAEJ ECOLX
MLNIIHRLKSGMFPALFFLTSASVLA

SEQ ID NO: 1499 - protein, 26 aa, Escherichia coli
  misc feature (1)..(26): Escherichia coli (strain UTI89/UPEC) Q1RE95 GSIB ECOUT
MARAVHRSGLVALGIATALMASCAFA

SEQ ID NO: 1500 - protein, 26 aa, Escherichia coli
  misc feature (1)..(26): Escherichia coli (strain K12) P0C0V0 DEGP ECOLI
MKKTTLALSALALSLGLALSPLSATA

SEQ ID NO: 1501 - protein, 26 aa, Escherichia coli
  misc feature (1)..(26): Escherichia coli O6 Q8CW88 GSIB ECOL6
MARAVHRSGLVALGIATALMASCAFA

SEQ ID NO: 1502 - protein, 26 aa, Escherichia coli
  misc feature (1)..(26): Escherichia coli (strain K12) P40876 YCBF ECOLI
MTNTWNRLALLIFAVLSLLVAGELQA

SEQ ID NO: 1503 - protein, 26 aa, Escherichia coli
  misc feature (1)..(26): Escherichia coli (strain ATCC 8739/DSM 1576/Crooks) B1ITP0 B1ITP0 ECOLC
MPHTIKKMSLIGLILMIFTSVFGFAN

SEQ ID NO: 1504 - protein, 26 aa, Escherichia coli
  misc feature (1)..(26): Escherichia coli O6:K15:H31 (strain 536/UPEC) Q0TJ49 YCDO ECOL5
MTINFRRNALQVSVAALFSSAFMANA

SEQ ID NO: 1505 - protein, 26 aa, Escherichia coli
  misc feature (1)..(26): Escherichia coli (strain K12) P0AEL6 FEPB ECOLI
MRLAPLYRNALLLTGLLLSGIAAVQA

SEQ ID NO: 1506 - protein, 26 aa, Escherichia coli
  misc feature (1)..(26): Escherichia coli O157:H7 P0AAB0 ZRAP ECO57
MKRNTKIALVMMALSAMAMGSTSAFA

SEQ ID NO: 1507 - protein, 26 aa, Escherichia coli
  misc feature (1)..(26): Escherichia coli O1:K1/APEC A1AIR1 NRFA ECOK1
MTRIKINARRIFSLLIPFFFFTSVHA

SEQ ID NO: 1508 - protein, 26 aa, Escherichia coli
  misc feature (1)..(26): Escherichia coli (strain ATCC 8739/DSM 1576/Crooks) B1IRM0 B1IRM0 ECOLC
MVAKINLLSRLTPLLFVFAPFFAQSN

SEQ ID NO: 1509 - protein, 26 aa, Escherichia coli
  misc feature (1)..(26): Escherichia coli O9:H4 (strain HS) A8A069 LSRB ECOHS
MTLHRFKKIALLSVLGIAAISMNVQA

SEQ ID NO: 1510 - protein, 26 aa, Escherichia coli
  misc feature (1)..(26): Escherichia coli (strain K12) P0AFV4 SPR ECOLI
MVKSQPILRYILRGIPAIAVAVLLSA

SEQ ID NO: 1511 - protein, 26 aa, Escherichia coli
  misc feature (1)..(26): Escherichia coli O6 Q8CWA2 CUSB ECOL6
MKKIALIIGSMIAGGIISAAGFTWFA

SEQ ID NO: 1512 - protein, 26 aa, Escherichia coli
  misc feature (1)..(26): Escherichia coli (strain ATCC 8739/DSM 1576/Crooks) B1IYI4 B1IYI4 ECOLC
MNVSKYVAIFSFVFIQLISVGKVFAN

SEQ ID NO: 1513 - protein, 26 aa, Escherichia coli
  misc feature (1)..(26): Escherichia coli (strain ATCC 8739/DSM 1576/Crooks) B1IQK4 B1IQK4 ECOLC
MLFQEHNFALFFGLVTALCSPVSLAN

SEQ ID NO: 1514 - protein, 26 aa, Escherichia coli
  misc feature (1)..(26): Escherichia coli (strain K12) P39172 ZNUA ECOLI
MLHKKTLLFAALSAALWGGATQAADA

SEQ ID NO: 1515 - protein, 26 aa, Escherichia coli
  misc feature (1)..(26): Escherichia coli (strain ATCC 8739/DSM 1576/Crooks) B1J0W1 B1J0W1 ECOLC
MNSIFTEENLLAFTTAARFGSFSKAA

SEQ ID NO: 1516 - protein, 26 aa, Escherichia coli
  misc feature (1)..(26): Escherichia coli (strain ATCC 8739/DSM 1576/Crooks) B1IQS4 B1IQS4 ECOLC
MSKARRWVIIVLSLAVLVMIGINMAE

SEQ ID NO: 1517 - protein, 27 aa, Escherichia coli
  misc feature (1)..(27): Escherichia coli (strain ATCC 8739/DSM 1576/Crooks) B1IT80 B1IT80 ECOLC
MFSYYFQGLALGAAMILPLGPQNAFVM

SEQ ID NO: 1518 - protein, 27 aa, Escherichia coli
  misc feature (1)..(27): Escherichia coli (strain ATCC 8739/DSM 1576/Crooks) B1ISF5 B1ISF5 ECOLC
MNRRNFIKAASCGALLTGALPSVSHAA

SEQ ID NO: 1519 - protein, 27 aa, Escherichia coli
  misc feature (1)..(27): Escherichia coli (strain ATCC 8739/DSM 1576/Crooks) B1IWS4 B1IWS4 ECOLC
MKHKQRWAGAICCFVLFIVVCLFLATH

SEQ ID NO: 1520 - protein, 27 aa, Escherichia coli
  misc feature (1)..(27): Escherichia coli (strain ATCC 8739/DSM 1576/Crooks) B1IUL4 B1IUL4 ECOLC
MKMNKSLIALCLSAGLLASAPGISLAD

SEQ ID NO: 1521 - protein, 27 aa, Escherichia coli
  misc feature (1)..(27): Escherichia coli (strain ATCC 8739/DSM 1576/Crooks) B1IXY8 B1IXY8 ECOLC
MQLNKVLKGLMIALPVMAIAACSSNKN

SEQ ID NO: 1522 - protein, 27 aa, Escherichia coli
  misc feature (1)..(27): Escherichia coli (strain ATCC 8739/DSM 1576/Crooks) B1J0T8 B1J0T8 ECOLC
MRNHQKTFTMLLVLVLIGLNMRPLLTS

SEQ ID NO: 1523 - protein, 27 aa, Escherichia coli
  misc feature (1)..(27): Escherichia coli (strain ATCC 8739/DSM 1576/Crooks) B1ITV5 B1ITV5 ECOLC
MNAKIIASLAFTSMFSLSTLLSPAHAE

SEQ ID NO: 1524 - protein, 27 aa, Escherichia coli
  misc feature (1)..(27): Escherichia coli (strain K12) P0ABL3 NAPB ECOLI
MKSHDLKKALCQWTAMLALVVSGAVWA

SEQ ID NO: 1525 - protein, 27 aa, Escherichia coli
  misc feature (1)..(27): Escherichia coli (strain ATCC 8739/DSM 1576/Crooks) B1IU20 B1IU20 ECOLC
MNREKGVSSLALVLMLLVLGSLLLQGM

SEQ ID NO: 1526 - protein, 27 aa, Escherichia coli
  misc feature (1)..(27): Escherichia coli (strain K12) P32711 NRFF ECOLI
MNKGLLTLLLLFTCFAHAQVVDTWQFA

SEQ ID NO: 1527 - protein, 27 aa, Escherichia coli
  misc feature (1)..(27): Escherichia coli (strain ATCC 8739/DSM 1576/Crooks) B1IPH9 B1IPH9 ECOLC
MSQHYSVSWKKGLAALCLLAVAGLSGC

SEQ ID NO: 1528 - protein, 27 aa, Escherichia coli
  misc feature (1)..(27): Escherichia coli (strain ATCC 8739/DSM 1576/Crooks) B1IVB4 B1IVB4 ECOLC
MKQANQDRGTLLLALVAGLSINGTFAA

SEQ ID NO: 1529 - protein, 27 aa, Escherichia coli
  misc feature (1)..(27): Escherichia coli (strain K12) P77199 YAIT ECOLI
MHSWKKKLVVSQLALACTLAITSQANA

SEQ ID NO: 1530 - protein, 27 aa, Escherichia coli
  misc feature (1)..(27): Escherichia coli (strain K12) P76499 YFCP ECOLI
MNKSMIQSGGYVLLAGLILAMSSTLFA

SEQ ID NO: 1531 - protein, 27 aa, Escherichia coli
  misc feature (1)..(27): Escherichia coli (strain ATCC 8739/DSM 1576/Crooks) B1IWR8 B1IWR8 ECOLC
MTALNKKWLSGLVAGALMAVSVGTLAA

SEQ ID NO: 1532 - protein, 27 aa, Escherichia coli
  misc feature (1)..(27): Escherichia coli (strain K12) P0AAJ8 HYBA ECOLI
MNRRNFIKAASCGALLTGALPSVSHAA

SEQ ID NO: 1533 - protein, 27 aa, Escherichia coli
  misc feature (1)..(27): Escherichia coli O157:H7 P0AAJ9 HYBA ECO57
MNRRNFIKAASCGALLTGALPSVSHAA

SEQ ID NO: 1534 - protein, 27 aa, Escherichia coli
  misc feature (1)..(27): Escherichia coli O157:H7 P0AAK8 NRFC ECO57
MTWSRRQFLTGVGVLAAVSGTAGRVVA

SEQ ID NO: 1535 - protein, 27 aa, Escherichia coli
  misc feature (1)..(27): Escherichia coli (strain K12) P64426 YDDW ECOLI
MDICSRNKKLTIRRPAILVALALLLCS

SEQ ID NO: 1536 - protein, 27 aa, Escherichia coli
  misc feature (1)..(27): Escherichia coli (strain ATCC 8739/DSM 1576/Crooks) B1IXY7 B1IXY7 ECOLC
MSSNFRHQLLSLSLLVGIAAPWAAFAQ

SEQ ID NO: 1537 - protein, 27 aa, Escherichia coli
  misc feature (1)..(27): Escherichia coli O157:H7 Q8X5S5 NRFF ECO57
MYKGLLTLLLLFTCFARAQVVDTWQFA

SEQ ID NO: 1538 - protein, 27 aa, Escherichia coli
  misc feature (1)..(27): Escherichia coli O6 P0A4L7 DSBL ECOL6
MSKLGISSLFKTILLTAALAVSFTASA

SEQ ID NO: 1539 - protein, 27 aa, Escherichia coli
  misc feature (1)..(27): Escherichia coli (strain K12) P26648 SUFI ECOLI
MSLSRRQFIQASGIALCAGAVPLKASA

SEQ ID NO: 1540 - protein, 27 aa, Escherichia coli
  misc feature (1)..(27): Escherichia coli (strain ATCC 8739/DSM 1576/Crooks) B1IXD9 B1IXD9 ECOLC
MARAVHRSGLVALGIATALMASCAFAA

SEQ ID NO: 1541 - protein, 27 aa, Escherichia coli
  misc feature (1)..(27): Escherichia coli O6 P0ADV2 LPTA ECOL6
MKFKTNKLSLNLVLASSLLAASIPAFA

SEQ ID NO: 1542 - protein, 27 aa, Escherichia coli
  misc feature (1)..(27): Escherichia coli O157:H7 Q8XAD2 YFGC ECO57
MFRQLKKNLVATLIAAMTIGQVAPAFA

SEQ ID NO: 1543 - protein, 27 aa, Escherichia coli
  misc feature (1)..(27): Escherichia coli (strain ATCC 8739/DSM 1576/Crooks) B1IU61 B1IU61 ECOLC
MTTNYIFVTGGVVSSLGKGIAAASLAA

SEQ ID NO: 1544 - protein, 27 aa, Escherichia coli
  misc feature (1)..(27): Escherichia coli (strain K12) P76190 YDHO ECOLI
MARINRISITLCALLFTTLPLTPMAHA

SEQ ID NO: 1545 - protein, 27 aa, Escherichia coli
  misc feature (1)..(27): Escherichia coli (strain ATCC 8739/DSM 1576/Crooks) B1IVY8 B1IVY8 ECOLC
MTNTWNRLALLIFAVLSLLVAGELQAG

SEQ ID NO: 1546 - protein, 27 aa, Escherichia coli
  misc feature (1)..(27): Escherichia coli (strain ATCC 8739/DSM 1576/Crooks) B1IZN2 B1IZN2 ECOLC
MMMNAFFPAMALMVLVGCSTPPPEQKA

SEQ ID NO: 1547 - protein, 27 aa, Escherichia coli
  misc feature (1)..(27): Escherichia coli (strain ATCC 8739/DSM 1576/Crooks) B1IYL4 B1IYL4 ECOLC
MRLAPLYRNALLLTGLLLSGIAAVQAA

SEQ ID NO: 1548 - protein, 27 aa, Escherichia coli
  misc feature (1)..(27): Escherichia coli (strain ATCC 8739/DSM 1576/Crooks) B1ITS9 B1ITS9 ECOLC
MSSAKKIGLFACTGVVAGNMMGSGIAL

SEQ ID NO: 1549 - protein, 27 aa, Escherichia coli
  misc feature (1)..(27): Escherichia coli (strain ATCC 8739/DSM 1576/Crooks) B1IV80 B1IV80 ECOLC
MTINFRRNALQLSVAALFSSAFMANAA

SEQ ID NO: 1550 - protein, 27 aa, Escherichia coli
  misc feature (1)..(27): Escherichia coli (strain ATCC 8739/DSM 1576/Crooks) B1IVS9 B1IVS9 ECOLC
MPKKMRTTRNLLLMATLLGSALFARAA

SEQ ID NO: 1551 - protein, 27 aa, Escherichia coli
  misc feature (1)..(27): Escherichia coli (strain ATCC 8739/DSM 1576/Crooks) B1IUL7 B1IUL7 ECOLC
MKIKTGARILALSALTTMMFSASALAK

SEQ ID NO: 1552 - protein, 27 aa, Escherichia coli
  misc feature (1)..(27): Escherichia coli O157:H7 P0ADV3 LPTA ECO57
MKFKTNKLSLNLVLASSLLAASIPAFA

SEQ ID NO: 1553 - protein, 27 aa, Escherichia coli
  misc feature (1)..(27): Escherichia coli (strain ATCC 8739/DSM 1576/Crooks) B1J0P7 B1J0P7 ECOLC
MVSTARSLRYALAILTTSLVTPSVWAH

SEQ ID NO: 1554 - protein, 27 aa, Escherichia coli
  misc feature (1)..(27): Escherichia coli (strain K12) P0AAK7 NRFC ECOLI
MTWSRRQFLTGVGVLAAVSGTAGRVVA

SEQ ID NO: 1555 - protein, 27 aa, Escherichia coli
  misc feature (1)..(27): Escherichia coli (strain ATCC 8739/DSM 1576/Crooks) B1IZ10 B1IZ10 ECOLC
MRRFLTTLMILLVVLVAGLSALVLLVN

SEQ ID NO: 1556 - protein, 27 aa, Escherichia coli
  misc feature (1)..(27): Escherichia coli O6 Q8CW29 YDDW ECOL6
MDICSRNEKLAIRRPAILVALALLLCS

SEQ ID NO: 1557 - protein, 27 aa, Escherichia coli
  misc feature (1)..(27): Escherichia coli (strain ATCC 8739/DSM 1576/Crooks) B1IS58 B1IS58 ECOLC
MMMKTVKHLLCCAIAASALISTGVHAA

SEQ ID NO: 1558 - protein, 27 aa, Escherichia coli
  misc feature (1)..(27): Escherichia coli P17543 PAPJ ECOLX
MVVNKTTAVLYLIALSLSGFIHTFLRA

SEQ ID NO: 1559 - protein, 27 aa, Escherichia coli
  misc feature (1)..(27): Escherichia coli O6:K15:H31 (strain 536/UPEC) P13429 SFAG ECOL5
MVKDIIKTVTFSCMLAGSMFVTCHVCA

SEQ ID NO: 1560 - protein, 27 aa, Escherichia coli
  misc feature (1)..(27): Escherichia coli (strain K12) P08506 DACC ECOLI
MTQYSSLLRGLAAGSAFLFLFAPTAFA

SEQ ID NO: 1561 - protein, 27 aa, Escherichia coli
  misc feature (1)..(27): Escherichia coli (strain ATCC 8739/DSM 1576/Crooks) B1ISY3 B1ISY3 ECOLC
MLNSILVILCLIAVSAFFSMSEISLAA

SEQ ID NO: 1562 - protein, 27 aa, Escherichia coli
  misc feature (1)..(27): Escherichia coli (strain ATCC 8739/DSM 1576/Crooks) B1IVZ2 B1IVZ2 ECOLC
MKTCITKGIVTVSLTAILLSCSSAWAA

SEQ ID NO: 1563 - protein, 27 aa, Escherichia coli
  misc feature (1)..(27): Escherichia coli (strain ATCC 8739/DSM 1576/Crooks) B1IP37 B1IP37 ECOLC
MERIMQNRKWILTSLVMTFFGIPILAQ

SEQ ID NO: 1564 - protein, 27 aa, Escherichia coli
  misc feature (1)..(27): Escherichia coli (strain ATCC 8739/DSM 1576/Crooks) B1IXR4 B1IXR4 ECOLC
MNMLALTIILPLIGFVLLAFSRGRWSE

SEQ ID NO: 1565 - protein, 27 aa, Escherichia coli
  misc feature (1)..(27): Escherichia coli (strain ATCC 8739/DSM 1576/Crooks) B1IRN9 B1IRN9 ECOLC
MSDTKRNTIGKFGLLSLTFAAVYSFNN

SEQ ID NO: 1566 - protein, 27 aa, Escherichia coli
  misc feature (1)..(27): Escherichia coli (strain ATCC 8739/DSM 1576/Crooks) B1IQ26 B1IQ26 ECOLC
MANFFIRRPIFAWVLAIILMMAGALAI

SEQ ID NO: 1567 - protein, 27 aa, Escherichia coli
  misc feature (1)..(27): Escherichia coli (strain ATCC 8739/DSM 1576/Crooks) B1IQH9 B1IQH9 ECOLC
MKKTTLALSALALSLGLALSPLSATAA

SEQ ID NO: 1568 - protein, 27 aa, Escherichia coli
  misc feature (1)..(27): Escherichia coli P42189 PRSJ ECOLX
MVVNKTTAVLYLIALSLSGFIHTFLRA

SEQ ID NO: 1569 - protein, 27 aa, Escherichia coli
  misc feature (1)..(27): Escherichia coli (strain K12) P39099 DEGQ ECOLI
MKKQTQLLSALALSVGLTLSASFQAVA

SEQ ID NO: 1570 - protein, 27 aa, Escherichia coli
  misc feature (1)..(27): Escherichia coli (strain K12) P0ADV1 LPTA ECOLI
MKFKTNKLSLNLVLASSLLAASIPAFA

SEQ ID NO: 1571 - protein, 27 aa, Escherichia coli
  misc feature (1)..(27): Escherichia coli (strain ATCC 8739/DSM 1576/Crooks) B1IWP7 B1IWP7 ECOLC
MFRKLAAECFGTFWLVFGGCGSAVLAA

SEQ ID NO: 1572 - protein, 27 aa, Escherichia coli
  misc feature (1)..(27): Escherichia coli (strain ATCC 8739/DSM 1576/Crooks) B1IUP5 B1IUP5 ECOLC
MKRNTKIALVMMALSAMAMGSTSAFAH

SEQ ID NO: 1573 - protein, 27 aa, Escherichia coli
  misc feature (1)..(27): Escherichia coli O157:H7 P0AGC4 SLT ECO57
MEKAKQVTWRLLAAGVCLLTVSSVARA

SEQ ID NO: 1574 - protein, 27 aa, Escherichia coli
  misc feature (1)..(27): Escherichia coli (strain K12) P0AGC3 SLT ECOLI
MEKAKQVTWRLLAAGVCLLTVSSVARA

SEQ ID NO: 1575 - protein, 27 aa, Escherichia coli
  misc feature (1)..(27): Escherichia coli (strain ATCC 8739/DSM 1576/Crooks) B1IPU7 B1IPU7 ECOLC
MKAKAILLASVLLVGCQSTGNVQQHAQ

SEQ ID NO: 1576 - protein, 27 aa, Escherichia coli
  misc feature (1)..(27): Escherichia coli (strain K12) P77263 YAGV ECOLI
MFRRRGVTLTKALLTAVCMLAAPLTQA

SEQ ID NO: 1577 - protein, 27 aa, Escherichia coli
  misc feature (1)..(27): Escherichia coli (strain K12) P31600 NFRA ECOLI
MKENNLNRVIGWSGLLLTSLLSTSALA

SEQ ID NO: 1578 - protein, 27 aa, Escherichia coli
  misc feature (1)..(27): Escherichia coli (strain ATCC 8739/DSM 1576/Crooks) B1IPT0 B1IPT0 ECOLC
MNIFTTRLTTSLVVIGTLLLSGCDSKE

SEQ ID NO: 1579 - protein, 27 aa, Escherichia coli
  misc feature (1)..(27): Escherichia coli (strain ATCC 8739/DSM 1576/Crooks) B1J0L5 B1J0L5 ECOLC
MRGKKRIGLLFLLIAVVVGGGGLLLAQ

SEQ ID NO: 1580 - protein, 27 aa, Escherichia coli
  misc feature (1)..(27): Escherichia coli O157:H7 P64427 YDDW ECO57
MDICSRNKKLTIRRPAILVALALLLCS

SEQ ID NO: 1581 - protein, 27 aa, Escherichia coli
  misc feature (1)..(27): Escherichia coli Q07682 Q07682 ECOLX
MINKTMKNYLVLFFLVMLTVISLIIFA

SEQ ID NO: 1582 - protein, 27 aa, Escherichia coli
  misc feature (1)..(27): Escherichia coli (strain ATCC 8739/DSM 1576/Crooks) B1IPR9 B1IPR9 ECOLC
MASLKIKYAAIIISSLIAGGLISVTAW

SEQ ID NO: 1583 - protein, 27 aa, Escherichia coli
  misc feature (1)..(27): Escherichia coli (strain K12) P66948 YFGC ECOLI
MFRQLKKNLVATLIAAMTIGQVAPAFA

SEQ ID NO: 1584 - protein, 28 aa, Escherichia coli
  misc feature (1)..(28): Escherichia coli (strain ATCC 8739/DSM 1576/Crooks) B1J0A9 B1J0A9 ECOLC
MRKRTMSKAGKITAAISGAFLLLIVVAI

SEQ ID NO: 1585 - protein, 28 aa, Escherichia coli
  misc feature (1)..(28): Escherichia coli (strain ATCC 8739/DSM 1576/Crooks) B1IXC8 B1IXC8 ECOLC
MTQYSSLLRGLAAGSAFLFLFAPTAFAA

SEQ ID NO: 1586 - protein, 28 aa, Escherichia coli
  misc feature (1)..(28): Escherichia coli O157:H7 Q8XEH9 CUSB ECO57
MKKIALIIGSMIAGGIISAAGFTWFAKA

SEQ ID NO: 1587 - protein, 28 aa, Escherichia coli
  misc feature (1)..(28): Escherichia coli (strain DH10B) B1XF48 YNFB ECODH
MKITLSKRIGLLAILLPCALALSTTVHA

SEQ ID NO: 1588 - protein, 28 aa, Escherichia coli
  misc feature (1)..(28): Escherichia coli (strain K12) P77599 YFCS ECOLI
MSDLLCSAKLGAMTLALLLSATSLSALA

SEQ ID NO: 1589 - protein, 28 aa, Escherichia coli
  misc feature (1)..(28): Escherichia coli O139:H28 (strain E24377A/ETEC) A7ZM42 YNFB ECO24
MKITLSKRIGLLAFLLPCALALSTTVHA

SEQ ID NO: 1590 - protein, 28 aa, Escherichia coli
  misc feature (1)..(28): Escherichia coli (strain K12) P36649 CUEO ECOLI
MQRRDFLKYSVALGVASALPLWSRAVFA

SEQ ID NO: 1591 - protein, 28 aa, Escherichia coli
  misc feature (1)..(28): Escherichia coli (strain K12) P0AD59 IVY ECOLI
MGRISSGGMMFKAITTVAALVIATSAMA

SEQ ID NO: 1592 - protein, 28 aa, Escherichia coli
  misc feature (1)..(28): Escherichia coli O6 P0AFH9 OSMY ECOL6
MTMTRLKISKTLLAVMLTSAVATGSAYA

SEQ ID NO: 1593 - protein, 28 aa, Escherichia coli
  misc feature (1)..(28): Escherichia coli O6:K15:H31 (strain 536/UPEC) Q0THP1 YNFB ECOL5
MKITLSKRIGLLAFLLPCALALSTTVHA

SEQ ID NO: 1594 - protein, 28 aa, Escherichia coli
  misc feature (1)..(28): Escherichia coli O157:H7 P64436 YBCW ECO57
MNKEQSADDPSVDLIRVKNMLNSTISMS

SEQ ID NO: 1595 - protein, 28 aa, Escherichia coli
  misc feature (1)..(28): Escherichia coli (strain K12) P77239 CUSB ECOLI
MKKIALIIGSMIAGGIISAAGFTWVAKA

SEQ ID NO: 1596 - protein, 28 aa, Escherichia coli
  misc feature (1)..(28): Escherichia coli (strain ATCC 8739/DSM 1576/Crooks) B1ITZ6 B1ITZ6 ECOLC
MIDYKKNLLFILVFISGFILFTVYSYTA

SEQ ID NO: 1597 - protein, 28 aa, Escherichia coli
  misc feature (1)..(28): Escherichia coli (strain K12) P23847 DPPA ECOLI
MRISLKKSGMLKLGLSLVAMTVAASVQA

SEQ ID NO: 1598 - protein, 28 aa, Escherichia coli
  misc feature (1)..(28): Escherichia coli O6 Q8CW20 YNFB ECOL6
MKITLSKRIGLLAFLLPCALALSTTVHA

SEQ ID NO: 1599 - protein, 28 aa, Escherichia coli
  misc feature (1)..(28): Escherichia coli O1:K1/APEC A1ABC8 YNFB ECOK1
MKITLSKRIGLLAFLLPCALALSTTVHA

SEQ ID NO: 1600 - protein, 28 aa, Escherichia coli
  misc feature (1)..(28): Escherichia coli (strain ATCC 8739/DSM 1576/Crooks) B1IZ63 B1IZ63 ECOLC
MKENNLNRVIGWSGLLLTSLLSTSALAD

SEQ ID NO: 1601 - protein, 28 aa, Escherichia coli
  misc feature (1)..(28): Escherichia coli (strain ATCC 8739/DSM 1576/Crooks) B1IZE2 B1IZE2 ECOLC
MKIATIKTGLASLAMLPGLVMAAPAVAD

SEQ ID NO: 1602 - protein, 28 aa, Escherichia coli
  misc feature (1)..(28): Escherichia coli (strain ATCC 8739/DSM 1576/Crooks) B1ITP2 B1ITP2 ECOLC
MQTFQADLAIVGAGGAGLRAAIAAAQAN

SEQ ID NO: 1603 - protein, 28 aa, Escherichia coli
  misc feature (1)..(28): Escherichia coli (strain ATCC 8739/DSM 1576/Crooks) B1IPX4 B1IPX4 ECOLC
MDCVMKGLNKITCCLLAALLMPCAGHAE

SEQ ID NO: 1604 - protein, 28 aa, Escherichia coli
  misc feature (1)..(28): Escherichia coli (strain SMS-3-5/SECEC) B1LEV3 YNFB ECOSM
MKITLSKRIGLLAFLLPCALALSTTVHA

SEQ ID NO: 1605 - protein, 28 aa, Escherichia coli
  misc feature (1)..(28): Escherichia coli (strain K12) P64435 YBCW ECOLI
MNKEQSADDPSVDLIRVKNMLNSTISMS

SEQ ID NO: 1606 - protein, 28 aa, Escherichia coli
  misc feature (1)..(28): Escherichia coli (strain ATCC 8739/DSM 1576/Crooks) B1ISD9 B1ISD9 ECOLC
MSLSRRQFIQASGIALCAGAVPLKASAA

SEQ ID NO: 1607 - protein, 28 aa, Escherichia coli
  misc feature (1)..(28): Escherichia coli (strain ATCC 8739/DSM 1576/Crooks) B1IZM2 B1IZM2 ECOLC
MILTPIRRYGAMILMLLTLVFSSEVLAK

SEQ ID NO: 1608 - protein, 28 aa, Escherichia coli
  misc feature (1)..(28): Escherichia coli P46007 AGGA ECOLX
MKTLKNMRRKNLCITLGLVSLLSRGANA

SEQ ID NO: 1609 - protein, 28 aa, Escherichia coli
  misc feature (1)..(28): Escherichia coli (strain ATCC 8739/DSM 1576/Crooks) B1IQU5 B1IQU5 ECOLC
MAKNLILWLVIAVVLMSVFQSFGPSESN

SEQ ID NO: 1610 - protein, 28 aa, Escherichia coli
  misc feature (1)..(28): Escherichia coli (strain K12) P75858 YCBT ECOLI
MQIIFGEKCVSLLRLFFAAVLMLWCAQT

SEQ ID NO: 1611 - protein, 28 aa, Escherichia coli
  misc feature (1)..(28): Escherichia coli (strain ATCC 8739/DSM 1576/Crooks) B1J0F2 B1J0F2 ECOLC
MNFFLSSRWSVRLALIIIALLALIALTS

SEQ ID NO: 1612 - protein, 28 aa, Escherichia coli
  misc feature (1)..(28): Escherichia coli (strain K12) P37017 YADL ECOLI
MMTFKNLRYGLSSSVVLAASLFSVLSYA

SEQ ID NO: 1613 - protein, 28 aa, Escherichia coli
  misc feature (1)..(28): Escherichia coli (strain ATCC 8739/DSM 1576/Crooks) B1IX40 B1IX40 ECOLC
MKSLRLMLCAMPLMLTGCSTMSSVNWSA

SEQ ID NO: 1614 - protein, 28 aa, Escherichia coli
  misc feature (1)..(28): Escherichia coli (strain ATCC 8739/DSM 1576/Crooks) B1IWE2 B1IWE2 ECOLC
MPRLLTKRGCWITLAAAPFLLFLAAWGA

SEQ ID NO: 1615 - protein, 28 aa, Escherichia coli
  misc feature (1)..(28): Escherichia coli (strain ATCC 8739/DSM 1576/Crooks) B1IUH9 B1IUH9 ECOLC
MTWSRRQFLTGVGVLAAVSGTAGRVVAK

SEQ ID NO: 1616 - protein, 28 aa, Escherichia coli
  misc feature (1)..(28): Escherichia coli O34165 O34165 ECOLX
MKAKKYENQIYNENGRRCQRHGRRLAIA

SEQ ID NO: 1617 - protein, 28 aa, Escherichia coli
  misc feature (1)..(28): Escherichia coli (strain ATCC 8739/DSM 1576/Crooks) B1IS27 B1IS27 ECOLC
MEKAKQVTWRLLAAGVCLLTVSSVARAD

SEQ ID NO: 1618 - protein, 28 aa, Escherichia coli
  misc feature (1)..(28): Escherichia coli (strain ATCC 8739/DSM 1576/Crooks) B1IYS9 B1IYS9 ECOLC
MKLTTHHLRTGAALLLAGILLAGCDQSS

SEQ ID NO: 1619 - protein, 28 aa, Escherichia coli
  misc feature (1)..(28): Escherichia coli O157:H7 Q8X947 CUEO ECO57
MQRRDFLKYSVALGVASALPLWSRAVFA

SEQ ID NO: 1620 - protein, 28 aa, Escherichia coli
  misc feature (1)..(28): Escherichia coli (strain K12) P64604 YRBD ECOLI
MQTKKNEIWVGIFLLAALLAALFVCLKA

SEQ ID NO: 1621 - protein, 28 aa, Escherichia coli
  misc feature (1)..(28): Escherichia coli (strain UTI89/UPEC) Q1RBL6 YNFB ECOUT
MKITLSKRIGLLAFLLPCALALSTTVHA

SEQ ID NO: 1622 - protein, 28 aa, Escherichia coli
  misc feature (1)..(28): Escherichia coli (strain ATCC 8739/DSM 1576/Crooks) B1IQP5 B1IQP5 ECOLC
MKKQTQLLSALALSVGLTLSASFQAVAS

SEQ ID NO: 1623 - protein, 28 aa, Escherichia coli
  misc feature (1)..(28): Escherichia coli (strain ATCC 8739/DSM 1576/Crooks) B1IY69 B1IY69 ECOLC
MKSHDLKKALCQWTAMLALVVSGAVWAA

SEQ ID NO: 1624 - protein, 28 aa, Escherichia coli
  misc feature (1)..(28): Escherichia coli (strain ATCC 8739/DSM 1576/Crooks) B1IZA3 B1IZA3 ECOLC
MNSHNITNESLALALMLVVVAILISHKE

SEQ ID NO: 1625 - protein, 28 aa, Escherichia coli
  misc feature (1)..(28): Escherichia coli (strain ATCC 8739/DSM 1576/Crooks) B1IWU6 B1IWU6 ECOLC
MNPSIIKRCLVGAVLAIAATLPGFQQLH

SEQ ID NO: 1626 - protein, 28 aa, Escherichia coli
  misc feature (1)..(28): Escherichia coli (strain ATCC 8739/DSM 1576/Crooks) B1ITQ4 B1ITQ4 ECOLC
MHVKYLAGIVGAALLMAGCSSSNELSAA

SEQ ID NO: 1627 - protein, 28 aa, Escherichia coli
  misc feature (1)..(28): Escherichia coli (strain ATCC 8739/DSM 1576/Crooks) B1IQS3 B1IQS3 ECOLC
MKFKTNKLSLNLVLASSLLAASIPAFAV

SEQ ID NO: 1628 - protein, 28 aa, Escherichia coli
  misc feature (1)..(28): Escherichia coli P28585 BLC1 ECOLX
MVKKSLRQFTLMATATVTLLLGSVPLYA

SEQ ID NO: 1629 - protein, 28 aa, Escherichia coli
  misc feature (1)..(28): Escherichia coli (strain K12) P76170 YNFB ECOLI
MKITLSKRIGLLAILLPCALALSTTVHA

SEQ ID NO: 1630 - protein, 28 aa, Escherichia coli
  misc feature (1)..(28): Escherichia coli O1:K1/APEC A1A9U6 OPGG ECOK1
MKHKLQMMKMRWLSAAVMLTLYTSSSWA

SEQ ID NO: 1631 - protein, 28 aa, Escherichia coli
  misc feature (1)..(28): Escherichia coli (strain ATCC 8739/DSM 1576/Crooks) B1IWY4 B1IWY4 ECOLC
MSDKKKRSMAGLPWIAAMAFFMQALDAT

SEQ ID NO: 1632 - protein, 28 aa, Escherichia coli
  misc feature (1)..(28): Escherichia coli (strain ATCC 8739/DSM 1576/Crooks) B1ITY0 B1ITY0 ECOLC
MINRQLSRLLLCSILGSTTLISGCALVR

SEQ ID NO: 1633 - protein, 28 aa, Escherichia coli
  misc feature (1)..(28): Escherichia coli (strain K12) P0AEE3 DEGS ECOLI
MFVKLLRSVAIGLIVGAILLVAMPSLRS

SEQ ID NO: 1634 - protein, 28 aa, Escherichia coli
  misc feature (1)..(28): Escherichia coli (strain ATCC 8739/DSM 1576/Crooks) B1IYF1 B1IYF1 ECOLC
MAFASLIERQRIRLLLALLFGACGTLAF

SEQ ID NO: 1635 - protein, 28 aa, Escherichia coli
  misc feature (1)..(28): Escherichia coli (strain ATCC 8739/DSM 1576/Crooks) B1IUF2 B1IUF2 ECOLC
MIKTRFSRWLTFFTFAAAVALALPAKAN

SEQ ID NO: 1636 - protein, 28 aa, Escherichia coli
  misc feature (1)..(28): Escherichia coli (strain ATCC 8739/DSM 1576/Crooks) B1IWG6 B1IWG6 ECOLC
MFRQLKKNLVATLIAAMTIGQVAPAFAD

SEQ ID NO: 1637 - protein, 28 aa, Escherichia coli
  misc feature (1)..(28): Escherichia coli (strain ATCC 8739/DSM 1576/Crooks) B1IPJ2 B1IPJ2 ECOLC
MEKKHIYLFCSAGMSTSLLVSKMRAQAE

SEQ ID NO: 1638 - protein, 28 aa, Escherichia coli
  misc feature (1)..(28): Escherichia coli (strain ATCC 8739/DSM 1576/Crooks) B1IS75 B1IS75 ECOLC
MDTKKLFKHIPWVILGIIGAFCLAVVAL

SEQ ID NO: 1639 - protein, 28 aa, Escherichia coli
  misc feature (1)..(28): Escherichia coli (strain ATCC 8739/DSM 1576/Crooks) B1IT01 B1IT01 ECOLC
MDYWLPIIVLFGAFFFMLALGVPIVYAI

SEQ ID NO: 1640 - protein, 28 aa, Escherichia coli
  misc feature (1)..(28): Escherichia coli (strain K12) P0AFH8 OSMY ECOLI
MTMTRLKISKTLLAVMLTSAVATGSAYA

SEQ ID NO: 1641 - protein, 28 aa, Escherichia coli
  misc feature (1)..(28): Escherichia coli (strain ATCC 8739/DSM 1576/Crooks) B1ITG0 B1ITG0 ECOLC
MIIFTLRRILLLIVTLFLLTFVGFSLSY

SEQ ID NO: 1642 - protein, 28 aa, Escherichia coli
  misc feature (1)..(28): Escherichia coli (strain UTI89/UPEC) Q1RDB0 OPGG ECOUT
MKHKLQMMKMRWLSAAVMLTLYTSSSWA

SEQ ID NO: 1643 - protein, 28 aa, Escherichia coli
  misc feature (1)..(28): Escherichia coli (strain ATCC 8739/DSM 1576/Crooks) B1IZF2 B1IZF2 ECOLC
MKVINLCTFLLCSILLVGCSSTRPPLTD

SEQ ID NO: 1644 - protein, 28 aa, Escherichia coli
  misc feature (1)..(28): Escherichia coli O157:H7 P64605 YRBD ECO57
MQTKKNEIWVGIFLLAALLAALFVCLKA

SEQ ID NO: 1645 - protein, 28 aa, Escherichia coli
  misc feature (1)..(28): Escherichia coli O9:H4 (strain HS) A8A0C3 YNFB ECOHS
MKITLSKRIGLLAILLPCALALSTTVHA

SEQ ID NO: 1646 - protein, 28 aa, Escherichia coli
  misc feature (1)..(28): Escherichia coli P53517 AFAC ECOLX
MRDTSSGRMRTGVTGLALAVMVACVMFR

SEQ ID NO: 1647 - protein, 28 aa, Escherichia coli
  misc feature (1)..(28): Escherichia coli (strain ATCC 8739/DSM 1576/Crooks) B1IWQ7 B1IWQ7 ECOLC
MRYSKLTMLIPCALLLSACTTVTPAYKD

SEQ ID NO: 1648 - protein, 28 aa, Escherichia coli
  misc feature (1)..(28): Escherichia coli (strain ATCC 8739/DSM 1576/Crooks) B1J074 B1J074 ECOLC
MHSWKKKLVVSQLALACTLAITSQANAA

SEQ ID NO: 1649 - protein, 28 aa, Escherichia coli
  misc feature (1)..(28): Escherichia coli O157:H7 Q8X7A0 YNFB ECO57
MKITLSKRIDLLAFLLPCALALSTTVHA

SEQ ID NO: 1650 - protein, 28 aa, Escherichia coli
  misc feature (1)..(28): Escherichia coli O157:H7 P0AD60 IVY ECO57
MGRISSGGMMFKAITTVAALVIATSAMA

SEQ ID NO: 1651 - protein, 28 aa, Escherichia coli
  misc feature (1)..(28): Escherichia coli (strain ATCC 8739/DSM 1576/Crooks) B1IQ99 B1IQ99 ECOLC
MARINRISITLCALLFTTLPLTPMAHAS

SEQ ID NO: 1652 - protein, 28 aa, Escherichia coli
  misc feature (1)..(28): Escherichia coli (strain ATCC 8739/DSM 1576/Crooks) B1J0K3 B1J0K3 ECOLC
MFNRIRISTTLFLILILCGILQIGSNGM

SEQ ID NO: 1653 - protein, 28 aa, Escherichia coli
  misc feature (1)..(28): Escherichia coli (strain ATCC 8739/DSM 1576/Crooks) B1IR07 YNFB ECOLC
MKITLSKRIGLLAILLPCALALSTTVHA

SEQ ID NO: 1654 - protein, 28 aa, Escherichia coli
  misc feature (1)..(28): Escherichia coli O69395 BLT2 ECOLX
MVTKRVQRMMSAAAACIPLLLGSPTLYA

SEQ ID NO: 1655 - protein, 28 aa, Escherichia coli
  misc feature (1)..(28): Escherichia coli O157:H7 P0AEE4 DEGS ECO57
MFVKLLRSVAIGLIVGAILLVAMPSLRS

SEQ ID NO: 1656 - protein, 28 aa, Escherichia coli
  misc feature (1)..(28): Escherichia coli (strain ATCC 8739/DSM 1576/Crooks) B1IXB2 B1IXB2 ECOLC
MKTAHIYSPGYALLAGLLLTASTGARAV

SEQ ID NO: 1657 - protein, 28 aa, Escherichia coli
  misc feature (1)..(28): Escherichia coli (strain ATCC 8739/DSM 1576/Crooks) B1IQ85 B1IQ85 ECOLC
MSFTRRKFVLGMGTVIFFTGSASSLLAN

SEQ ID NO: 1658 - protein, 28 aa, Escherichia coli
  misc feature (1)..(28): Escherichia coli P46739 NFAA ECOLX
MKAKKYENQIYNENGRRCQRHGRRLAIA

SEQ ID NO: 1659 - protein, 28 aa, Escherichia coli
  misc feature (1)..(28): Escherichia coli (strain K12) P76501 YFCR ECOLI
MTGGVMSQKFVVGAGLLVCSVCSLSAMA

SEQ ID NO: 1660 - protein, 29 aa, Escherichia coli
  misc feature (1)..(29): Escherichia coli (strain ATCC 8739/DSM 1576/Crooks) B1IRW6 B1IRW6 ECOLC
MATSVQTGKAKQLTLLGFFAITASMVMAV

SEQ ID NO: 1661 - protein, 29 aa, Escherichia coli
  misc feature (1)..(29): Escherichia coli (strain ATCC 8739/DSM 1576/Crooks) B1IYP8 B1IYP8 ECOLC
MKLNFKGFFKAAGLFPLALMLSGCISYAL

SEQ ID NO: 1662 - protein, 29 aa, Escherichia coli
  misc feature (1)..(29): Escherichia coli (strain K12) P0AEM9 FLIY ECOLI
MKLAHLGRQALMGVMAVALVAGMSVKSFA

SEQ ID NO: 1663 - protein, 29 aa, Escherichia coli
  misc feature (1)..(29): Escherichia coli O6 P0AET3 HDEB ECOL6
MNISSLRKAFIFMGAVAALSLVNAQSALA

SEQ ID NO: 1664 - protein, 29 aa, Escherichia coli
  misc feature (1)..(29): Escherichia coli P46738 NFAE ECOLX
MKMRAVAVFTGMLTGVLSVTGLLSAGAYA

SEQ ID NO: 1665 - protein, 29 aa, Escherichia coli
  misc feature (1)..(29): Escherichia coli (strain ATCC 8739/DSM 1576/Crooks) B1IQL7 B1IQL7 ECOLC
MQRRDFLKYSVALGVASALPLWSRAVFAA

SEQ ID NO: 1666 - protein, 29 aa, Escherichia coli
  misc feature (1)..(29): Escherichia coli (strain ATCC 8739/DSM 1576/Crooks) B1IXL6 B1IXL6 ECOLC
MNKKSLWKLILILAIPCIIGFMPAPAGLS

SEQ ID NO: 1667 - protein, 29 aa, Escherichia coli
  misc feature (1)..(29): Escherichia coli O1:K1/APEC A1AIK8 YJBT ECOK1
MKRNLIKVVKMKSYFAALMLSVSVLPAYA

SEQ ID NO: 1668 - protein, 29 aa, Escherichia coli
  misc feature (1)..(29): Escherichia coli (strain ATCC 8739/DSM 1576/Crooks) B1IQK5 B1IQK5 ECOLC
MQGKVKKILLHIYSAVLLFLASSWYVFAG

SEQ ID NO: 1669 - protein, 29 aa, Escherichia coli
  misc feature (1)..(29): Escherichia coli (strain ATCC 8739/DSM 1576/Crooks) B1IPP8 B1IPP8 ECOLC
MGRISSGGMMFKAITTVAALVIATSAMAQ

SEQ ID NO: 1670 - protein, 29 aa, Escherichia coli
  misc feature (1)..(29): Escherichia coli (strain ATCC 8739/DSM 1576/Crooks) B1IQY1 B1IQY1 ECOLC
MKKLFIQFYLLLFVCFLVMSLLVGLVYKF

SEQ ID NO: 1671 - protein, 29 aa, Escherichia coli
  misc feature (1)..(29): Escherichia coli (strain ATCC 8739/DSM 1576/Crooks) B1IUH5 B1IUH5 ECOLC
MKQPKIPVKMLTTLTILMVFLCVGSYLLS

SEQ ID NO: 1672 - protein, 29 aa, Escherichia coli
  misc feature (1)..(29): Escherichia coli (strain ATCC 8739/DSM 1576/Crooks) B1J0I5 B1J0I5 ECOLC
MKNRTLGSVFIVAGTTIGAGMLAMPLAAA

SEQ ID NO: 1673 - protein, 29 aa, Escherichia coli
  misc feature (1)..(29): Escherichia coli (strain ATCC 8739/DSM 1576/Crooks) B1IX62 B1IX62 ECOLC
MKLFRILDPFTLTLITVVLLASFFPARGD

SEQ ID NO: 1674 - protein, 29 aa, Escherichia coli
  misc feature (1)..(29): Escherichia coli (strain K12) P52143 YPJA ECOLI
MNRTSPYYCRRSVLSLLISALIYAPPGMA

SEQ ID NO: 1675 - protein, 29 aa, Escherichia coli
  misc feature (1)..(29): Escherichia coli Q47066 BLT1 ECOLX
MMTQSIRRSMLTVMATLPLLFSSATLHAQ

SEQ ID NO: 1676 - protein, 29 aa, Escherichia coli
  misc feature (1)..(29): Escherichia coli P53516 AFAB ECOLX
MKMRAVAVFTGMLTGVLSVAGLLSAGAYA

SEQ ID NO: 1677 - protein, 29 aa, Escherichia coli
  misc feature (1)..(29): Escherichia coli (strain ATCC 8739/DSM 1576/Crooks) B1IY77 B1IY77 ECOLC
MKRKVLLIPLIIFLAIAAALLWQLARNAE

SEQ ID NO: 1678 - protein, 29 aa, Escherichia coli
  misc feature (1)..(29): Escherichia coli (strain ATCC 8739/DSM 1576/Crooks) B1IXA9 B1IXA9 ECOLC
MFNLTNTAKIVVPALALLATAVSFSSHAS

SEQ ID NO: 1679 - protein, 29 aa, Escherichia coli
  misc feature (1)..(29): Escherichia coli (strain ATCC 8739/DSM 1576/Crooks) B1IZ31 B1IZ31 ECOLC
MPFKKLSRRTFLTASSALAFLHTPFARAL

SEQ ID NO: 1680 - protein, 29 aa, Escherichia coli
  misc feature (1)..(29): Escherichia coli (strain ATCC 8739/DSM 1576/Crooks) B1IVK7 B1IVK7 ECOLC
MMMPVLQKLPFSGLPFSGICGYSFSAVAK

SEQ ID NO: 1681 - protein, 29 aa, Escherichia coli
  misc feature (1)..(29): Escherichia coli Q6S361 Q6S361 ECOLX
MKMRAVAVFTGMLTGVLSVAGLLSAGAYA

SEQ ID NO: 1682 - protein, 29 aa, Escherichia coli
  misc feature (1)..(29): Escherichia coli Q79AS0 Q79AS0 ECOLX
MKKLAKNVLAAKVALVLALSVGTLAVTPA

SEQ ID NO: 1683 - protein, 29 aa, Escherichia coli
  misc feature (1)..(29): Escherichia coli (strain ATCC 8739/DSM 1576/Crooks) B1IPH8 B1IPH8 ECOLC
MMKIQSRKIWYYRITLIILLFAMLLAWAL

SEQ ID NO: 1684 - protein, 29 aa, Escherichia coli
  misc feature (1)..(29): Escherichia coli (strain ATCC 8739/DSM 1576/Crooks) B1IY27 B1IY27 ECOLC
MKYIIFLFRAIWLALSLLILFFSMHRLSL

SEQ ID NO: 1685 - protein, 29 aa, Escherichia coli
  misc feature (1)..(29): Escherichia coli (strain ATCC 8739/DSM 1576/Crooks) B1IV75 B1IV75 ECOLC
MLRNGNKYLLMLVSIIMLTACISQSRTSF

SEQ ID NO: 1686 - protein, 29 aa, Escherichia coli
  misc feature (1)..(29): Escherichia coli (strain ATCC 8739/DSM 1576/Crooks) B1IYN4 B1IYN4 ECOLC
MKKIALIIGSMIAGGIISAAGFTWVAKAE

SEQ ID NO: 1687 - protein, 29 aa, Escherichia coli
  misc feature (1)..(29): Escherichia coli (strain ATCC 8739/DSM 1576/Crooks) B1IYD4 B1IYD4 ECOLC
MLIMPKFRVSLFSLALMLAVPLAPQAVAK

SEQ ID NO: 1688 - protein, 29 aa, Escherichia coli
  misc feature (1)..(29): Escherichia coli (strain ATCC 8739/DSM 1576/Crooks) B1IQP4 B1IQP4 ECOLC
MFVKLLRSVAIGLIVGAILLVAMPSLRSL

SEQ ID NO: 1689 - protein, 29 aa, Escherichia coli
  misc feature (1)..(29): Escherichia coli (strain K12) A5A628 YJBT ECOLI
MKRNLIKVVKMKPYFAALMLSVSVLPAYA

SEQ ID NO: 1690 - protein, 29 aa, Escherichia coli
  misc feature (1)..(29): Escherichia coli (strain K12) P77318 YDEN ECOLI
MKSALKKSVVSTSISLILASGMAAFAAHA

SEQ ID NO: 1691 - protein, 29 aa, Escherichia coli
  misc feature (1)..(29): Escherichia coli (strain K12) P0AEB2 DACA ECOLI
MNTIFSARIMKRLALTTALCTAFISAAHA

SEQ ID NO: 1692 - protein, 29 aa, Escherichia coli
  misc feature (1)..(29): Escherichia coli (strain ATCC 8739/DSM 1576/Crooks) B1ITD7 B1ITD7 ECOLC
MEYFMKGKSALTLLLAGIFSCGTCQATGA

SEQ ID NO: 1693 - protein, 29 aa, Escherichia coli
  misc feature (1)..(29): Escherichia coli O6 P0AEB3 DACA ECOL6
MNTIFSARIMKRLALTTALCTAFISAAHA

SEQ ID NO: 1694 - protein, 29 aa, Escherichia coli
  misc feature (1)..(29): Escherichia coli (strain K12) P0AET2 HDEB ECOLI
MNISSLRKAFIFMGAVAALSLVNAQSALA

SEQ ID NO: 1695 - protein, 29 aa, Escherichia coli
  misc feature (1)..(29): Escherichia coli (strain K12) P46474 YHDP ECOLI
MRRLPGILLLTGAALVVIAALLVSGLRIA

SEQ ID NO: 1696 - protein, 29 aa, Escherichia coli
  misc feature (1)..(29): Escherichia coli (strain UTI89/UPEC) Q1R3Q7 YJBT ECOUT
MKRNLIKVVKMKSYFAALMLSVSVLPAYA

SEQ ID NO: 1697 - protein, 29 aa, Escherichia coli
  misc feature (1)..(29): Escherichia coli O6 P0AEN0 FLIY ECOL6
MKLAHLGRQALMGVMAVALVAGMSVKSFA

SEQ ID NO: 1698 - protein, 29 aa, Escherichia coli
  misc feature (1)..(29): Escherichia coli (strain K12) P33129 HTRE ECOLI
MTIEYTKNYHHLTRIATFCALLYCNTAFS

SEQ ID NO: 1699 - protein, 29 aa, Escherichia coli
  misc feature (1)..(29): Escherichia coli (strain ATCC 8739/DSM 1576/Crooks) B1IQT0 B1IQT0 ECOLC
MQTKKNEIWVGIFLLAALLAALFVCLKAA

SEQ ID NO: 1700 - protein, 29 aa, Escherichia coli
  misc feature (1)..(29): Escherichia coli (strain K12) P77196 YFCU ECOLI
MPDHSLFRLRILPWCIALAMSGSYSSVWA

SEQ ID NO: 1701 - protein, 29 aa, Escherichia coli
  misc feature (1)..(29): Escherichia coli O157:H7 P0AEB4 DACA ECO57
MNTIFSARIMKRLALTTALCTAFISAAHA

SEQ ID NO: 1702 - protein, 29 aa, Escherichia coli
  misc feature (1)..(29): Escherichia coli (strain ATCC 8739/DSM 1576/Crooks) B1IZP9 B1IZP9 ECOLC
MRISLKKSGMLKLGLSLVAMTVAASVQAK

SEQ ID NO: 1703 - protein, 29 aa, Escherichia coli
  misc feature (1)..(29): Escherichia coli (strain ATCC 8739/DSM 1576/Crooks) B1J0S3 B1J0S3 ECOLC
MQKAQRIIKTYRRNRMIVCTICALVTLAS

SEQ ID NO: 1704 - protein, 29 aa, Escherichia coli
  misc feature (1)..(29): Escherichia coli (strain ATCC 8739/DSM 1576/Crooks) B1IV27 B1IV27 ECOLC
MSIAVTTTDPTNTGVSTTSSSSLTGSNAA

SEQ ID NO: 1705 - protein, 29 aa, Escherichia coli
  misc feature (1)..(29): Escherichia coli Q7X2C1 Q7X2C1 ECOLX
MKQDKRRGLTRIALALALAGYCVAPVALA

SEQ ID NO: 1706 - protein, 29 aa, Escherichia coli
  misc feature (1)..(29): Escherichia coli (strain K12) P77802 YAGX ECOLI
MPLRRFSPGLKAQFAFGMVFLFVQPDASA

SEQ ID NO: 1707 - protein, 29 aa, Escherichia coli
  misc feature (1)..(29): Escherichia coli (strain ATCC 8739/DSM 1576/Crooks) B1ITU0 B1ITU0 ECOLC
MTRTLKPLILNTGALALTLILIYTGISAH

SEQ ID NO: 1708 - protein, 29 aa, Escherichia coli
  misc feature (1)..(29): Escherichia coli (strain ATCC 8739/DSM 1576/Crooks) B1IW73 B1IW73 ECOLC
MDFSIMVYAVIALVGVAIGWLFASYQHAQ

SEQ ID NO: 1709 - protein, 29 aa, Escherichia coli
  misc feature (1)..(29): Escherichia coli (strain ATCC 8739/DSM 1576/Crooks) B1IS44 B1IS44 ECOLC
MTMTRLKISKTLLAVMLTSAVATGSAYAE

SEQ ID NO: 1710 - protein, 29 aa, Escherichia coli
  misc feature (1)..(29): Escherichia coli O85185 O85185 ECOLX
MTGAGCRVMKFTRIALATLIMVVATSARA

SEQ ID NO: 1711 - protein, 29 aa, Escherichia coli
  misc feature (1)..(29): Escherichia coli O6 Q8FB40 YJBT ECOL6
MKRNLIKVVKMKPYFAALMLSVSVLPAYA

SEQ ID NO: 1712 - protein, 30 aa, Escherichia coli
  misc feature (1)..(30): Escherichia coli (strain ATCC 8739/DSM 1576/Crooks) B1IUT7 B1IUT7 ECOLC
MSAGSPKFTVRRIAALSLVSLWLAGCSDTS

SEQ ID NO: 1713 - protein, 30 aa, Escherichia coli
  misc feature (1)..(30): Escherichia coli (strain ATCC 8739/DSM 1576/Crooks) B1IY80 B1IY80 ECOLC
MHQSGSVSLCRSAISVLVATALYSPIALAS

SEQ ID NO: 1714 - protein, 30 aa, Escherichia coli
  misc feature (1)..(30): Escherichia coli Q03450 TRAF4 ECOLX
MSRFQRLTKYVAIGGGAALLLAGAAYLAGA

SEQ ID NO: 1715 - protein, 30 aa, Escherichia coli
  misc feature (1)..(30): Escherichia coli (strain K12) P46883 AMO ECOLI
MGSPSLYSARKTTLALAVALSFAWQAPVFA

SEQ ID NO: 1716 - protein, 30 aa, Escherichia coli
  misc feature (1)..(30): Escherichia coli (strain ATCC 8739/DSM 1576/Crooks) B1IU18 B1IU18 ECOLC
MKTQRGYTLIETLVAMLILVMLSASGLYGW

SEQ ID NO: 1717 - protein, 30 aa, Escherichia coli
  misc feature (1)..(30): Escherichia coli (strain ATCC 8739/DSM 1576/Crooks) B1IQG6 B1IQG6 ECOLC
MLKYRLISAFVLIPVVIAALFLLPPVGFAI

SEQ ID NO: 1718 - protein, 30 aa, Escherichia coli
  misc feature (1)..(30): Escherichia coli O139:H28 (strain E24377A/ETEC) A7ZKW9 TREA ECO24
MKSPAPSRPQKMALIPACIFLCFAALSVQA

SEQ ID NO: 1719 - protein, 30 aa, Escherichia coli
  misc feature (1)..(30): Escherichia coli (strain ATCC 8739/DSM 1576/Crooks) B1J0Y1 B1J0Y1 ECOLC
MPLRRFSPGLKAQFAFGMVFLFVQPDASAA

SEQ ID NO: 1720 - protein, 30 aa, Escherichia coli
  misc feature (1)..(30): Escherichia coli O157:H7 Q8X9X2 YNCE ECO57
MHLRHLFSLRLRGSLLLGSLLVASSFSTQA

SEQ ID NO: 1721 - protein, 30 aa, Escherichia coli; identical to SEQ ID NO: 1718
  misc feature (1)..(30): Escherichia coli (strain UTI89/UPEC) Q1RCP3 TREA ECOUT

SEQ ID NO: 1722 - protein, 30 aa, Escherichia coli; identical to SEQ ID NO: 1718
  misc feature (1)..(30): Escherichia coli O157:H7 Q8XDH7 TREA ECO57

SEQ ID NO: 1723 - protein, 30 aa, Escherichia coli
  misc feature (1)..(30): Escherichia coli (strain K12) P07822 FHUD ECOLI
MSGLPLISRRRLLTAMALSPLLWQMNTAHA

SEQ ID NO: 1724 - protein, 30 aa, Escherichia coli; identical to SEQ ID NO: 1718
  misc feature (1)..(30): Escherichia coli O6:K15:H31 (strain 536/UPEC) Q0TIH3 TREA ECOL5

SEQ ID NO: 1725 - protein, 30 aa, Escherichia coli; identical to SEQ ID NO: 1718
  misc feature (1)..(30): Escherichia coli (strain K12) P13482 TREA ECOLI

SEQ ID NO: 1726 - protein, 30 aa, Escherichia coli
  misc feature (1)..(30): Escherichia coli (strain K12) P0AB06 YCBK ECOLI
MDKFDANRRKLLALGGVALGAAILPTPAFA

SEQ ID NO: 1727 - protein, 30 aa, Escherichia coli
  misc feature (1)..(30): Escherichia coli (strain ATCC 8739/DSM 1576/Crooks) B1J0Y5 B1J0Y5 ECOLC
MNIFEQTPPNRRRYGLAAFIGLIAGVVSAF

SEQ ID NO: 1728 - protein, 30 aa, Escherichia coli
  misc feature (1)..(30): Escherichia coli (strain ATCC 8739/DSM 1576/Crooks) B1ITV6 B1ITV6 ECOLC
MQTITIAPPKRSWFSLLSWAVVLAVLVVSW

SEQ ID NO: 1729 - protein, 30 aa, Escherichia coli
  misc feature (1)..(30): Escherichia coli (strain ATCC 8739/DSM 1576/Crooks) B1J0C4 B1J0C4 ECOLC
MNISSLRKAFIFMGAVAALSLVNAQSALAA

SEQ ID NO: 1730 - protein, 30 aa, Escherichia coli
  misc feature (1)..(30): Escherichia coli (strain ATCC 8739/DSM 1576/Crooks) B1IXA8 B1IXA8 ECOLC
MPDHSLFRLRILPWCIALAISGSYSSVWAE

SEQ ID NO: 1731 - protein, 30 aa, Escherichia coli
  misc feature (1)..(30): Escherichia coli (strain ATCC 8739/DSM 1576/Crooks) B1IT17 B1IT17 ECOLC
MVSRKRNSVIYRFASLLLVLMLNACSALQG

SEQ ID NO: 1732 - protein, 30 aa, Escherichia coli
  misc feature (1)..(30): Escherichia coli (strain ATCC 8739/DSM 1576/Crooks) B1IRW0 B1IRW0 ECOLC
MKSALKKSVVSTSISLILASGMAAFAAHAA

SEQ ID NO: 1733 - protein, 30 aa, Escherichia coli; identical to SEQ ID NO: 1718
  misc feature (1)..(30): Escherichia coli (strain ATCC 8739/DSM 1576/Crooks) B1IU96 TREA ECOLC

SEQ ID NO: 1734 - protein, 30 aa, Escherichia coli; identical to SEQ ID NO: 1726
  misc feature (1)..(30): Escherichia coli O6 P0AB07 YCBK ECOL6

SEQ ID NO: 1735 - protein, 30 aa, Escherichia coli
  misc feature (1)..(30): Escherichia coli (strain ATCC 8739/DSM 1576/Crooks) B1ITU7 B1ITU7 ECOLC
MLKRLLKRPSLNLLAWLLLAAFYISICLNI

SEQ ID NO: 1736 - protein, 30 aa, Escherichia coli
  misc feature (1)..(30): Escherichia coli Q05119 TRAF5 ECOLX
MSRILKRIAAGVVIAGVAALLLAAGGYAAG

SEQ ID NO: 1737 - protein, 30 aa, Escherichia coli
  misc feature (1)..(30): Escherichia coli (strain K12) P52101 YFHK ECOLI
MKRWPVFPRSLRQLVMLAFLLILLPLLVLA

SEQ ID NO: 1738 - protein, 30 aa, Escherichia coli
  misc feature (1)..(30): Escherichia coli (strain ATCC 8739/DSM 1576/Crooks) B1ITX6 B1ITX6 ECOLC
MNNSRLFRLSRIVIALTAASGMMVNTANAK

SEQ ID NO: 1739 - protein, 30 aa, Escherichia coli
  misc feature (1)..(30): Escherichia coli (strain UTI89/UPEC) Q1R1V4 YUBK ECOUT
MCPECFFLMLCFCGYCSSSSSSFRSSPVYG

SEQ ID NO: 1740 - protein, 30 aa, Escherichia coli
  misc feature (1)..(30): Escherichia coli (strain ATCC 8739/DSM 1576/Crooks) B1IRL7 B1IRL7 ECOLC
MQIPRMSLRQLAWSGAVLLLVGTLLLAWSA

SEQ ID NO: 1741 - protein, 30 aa, Escherichia coli
  misc feature (1)..(30): Escherichia coli (strain ATCC 8739/DSM 1576/Crooks) B1IVK2 B1IVK2 ECOLC
MNRTSPYYCRRSVLSLLISALIYAPPGMAA

SEQ ID NO: 1742 - protein, 30 aa, Escherichia coli
  misc feature (1)..(30): Escherichia coli (strain ATCC 8739/DSM 1576/Crooks) B1IPX0 B1IPX0 ECOLC
MNQQRGFTLLEMMLVLALVAITASVVLFTY

SEQ ID NO: 1743 - protein, 30 aa, Escherichia coli
  misc feature (1)..(30): Escherichia coli (strain K12) P0AGC7 SMP ECOLI
MARTKLKFRLHRAVIVLFCLALLVALMQGA

SEQ ID NO: 1744 - protein, 30 aa, Escherichia coli; identical to SEQ ID NO: 1718
  misc feature (1)..(30): Escherichia coli O1:K1/APEC A1AAC5 TREA ECOK1

SEQ ID NO: 1745 - protein, 30 aa, Escherichia coli
  misc feature (1)..(30): Escherichia coli (strain K12) P76116 YNCE ECOLI
MHLRHLFSSRLRGSLLLGSLLVVSSFSTQA

SEQ ID NO: 1746 - protein, 30 aa, Escherichia coli
  misc feature (1)..(30): Escherichia coli (strain ATCC 8739/DSM 1576/Crooks) B1IY94 B1IY94 ECOLC
MVKSQPILRYILRGIPAIAVAVLLSACSAN

SEQ ID NO: 1747 - protein, 30 aa, Escherichia coli
  misc feature (1)..(30): Escherichia coli (strain ATCC 8739/DSM 1576/Crooks) B1IWR0 B1IWR0 ECOLC
MNEFFPLASAAGMTVGLAVCALIVGLALAM

SEQ ID NO: 1748 - protein, 30 aa, Escherichia coli
  misc feature (1)..(30): Escherichia coli (strain ATCC 8739/DSM 1576/Crooks) B1IRB1 B1IRB1 ECOLC
MATRRQPLIPGWLIPGVSAATLVVAVALAA

SEQ ID NO: 1749 - protein, 30 aa, Escherichia coli; identical to SEQ ID NO: 1743
  misc feature (1)..(30): Escherichia coli O157:H7 P60777 SMP ECO57

SEQ ID NO: 1750 - protein, 30 aa, Escherichia coli; identical to SEQ ID NO: 1718
  misc feature (1)..(30): Escherichia coli O9:H4 (strain HS) A7ZZD1 TREA ECOHS

SEQ ID NO: 1751 - protein, 30 aa, Escherichia coli
  misc feature (1)..(30): Escherichia coli (strain ATCC 8739/DSM 1576/Crooks) B1J0E1 B1J0E1 ECOLC
MNIYIGWLFKLIPLIMGLICIALGGFVLES

SEQ ID NO: 1752 - protein, 30 aa, Escherichia coli; identical to SEQ ID NO: 1726
  misc feature (1)..(30): Escherichia coli O157:H7 P0AB08 YCBK ECO57

SEQ ID NO: 1753 - protein, 30 aa, Escherichia coli; identical to SEQ ID NO: 1718
  misc feature (1)..(30): Escherichia coli O6 Q8CW46 TREA ECOL6

SEQ ID NO: 1754 - protein, 30 aa, Escherichia coli
  misc feature (1)..(30): Escherichia coli (strain ATCC 8739/DSM 1576/Crooks) B1IQX4 B1IQX4 ECOLC
MVPSTFSRLKAARCLPVVLAALIFAGCGTH

SEQ ID NO: 1755 - protein, 31 aa, Escherichia coli
  misc feature (1)..(31): Escherichia coli (strain ATCC 8739/DSM 1576/Crooks) B1IZT9 B1IZT9 ECOLC
MTLEETVLAIRLHKLAVALGVFIVSAPAFSH

SEQ ID NO: 1756 - protein, 31 aa, Escherichia coli
  misc feature (1)..(31): Escherichia coli (strain ATCC 8739/DSM 1576/Crooks) B1IQ94 B1IQ94 ECOLC
MQPGKRFLVWLAGLSVLGFLATDMYLPAFAA

SEQ ID NO: 1757 - protein, 31 aa, Escherichia coli
  misc feature (1)..(31): Escherichia coli (strain ATCC 8739/DSM 1576/Crooks) B1IPE5 B1IPE5 ECOLC
MKLHHRMLRHFIAASVIVLTSSFLIFELVAS

SEQ ID NO: 1758 - protein, 31 aa, Escherichia coli
  misc feature (1)..(31): Escherichia coli (strain ATCC 8739/DSM 1576/Crooks) B1IXV8 B1IXV8 ECOLC
MSGEKKAKGWRFYGLVGFGAIALLSAGVWAL

SEQ ID NO: 1759 - protein, 31 aa, Escherichia coli
  misc feature (1)..(31): Escherichia coli (strain ATCC 8739/DSM 1576/Crooks) B1IQY9 B1IQY9 ECOLC
MAKPIITLNGLKIVIMLGMLVIILCGIRFAA

SEQ ID NO: 1760 - protein, 31 aa, Escherichia coli
  misc feature (1)..(31): Escherichia coli (strain ATCC 8739/DSM 1576/Crooks) B1IS93 B1IS93 ECOLC
MTKSISLSKRISVIVILFAIVAVCTFFVQSC

SEQ ID NO: 1761 - protein, 31 aa, Escherichia coli
  misc feature (1)..(31): Escherichia coli O6 Q8CW90 FIU ECOL6
MENNRNFPARQFHSLTFFAGLCIGITPVAQA

SEQ ID NO: 1762 - protein, 31 aa, Escherichia coli
  misc feature (1)..(31): Escherichia coli (strain ATCC 8739/DSM 1576/Crooks) B1IXZ2 B1IXZ2 ECOLC
MNILDLFLKASLLVKLIMLILIGFSIASWAI

SEQ ID NO: 1763 - protein, 31 aa, Escherichia coli
  misc feature (1)..(31): Escherichia coli (strain ATCC 8739/DSM 1576/Crooks) B1J017 B1J017 ECOLC
MRLRKYNKSLGWLSLFAGTVLLSGCNSALLD

SEQ ID NO: 1764 - protein, 31 aa, Escherichia coli
  misc feature (1)..(31): Escherichia coli (strain ATCC 8739/DSM 1576/Crooks) B1IW06 B1IW06 ECOLC
MLLNMMCGRRLSAISLCLAVTFAPLFNAQAD

SEQ ID NO: 1765 - protein, 31 aa, Escherichia coli
  misc feature (1)..(31): Escherichia coli (strain ATCC 8739/DSM 1576/Crooks) B1IS32 B1IS32 ECOLC
MARTKLKFRLHRAVIVLFCLALLVALMQGAS

SEQ ID NO: 1766 - protein, 31 aa, Escherichia coli
  misc feature (1)..(31): Escherichia coli (strain K12) P33342 YEHC ECOLI
MAAIPWRPFNLRGIKMKGLLSLLIFSMVLPA

SEQ ID NO: 1767 - protein, 31 aa, Escherichia coli
  misc feature (1)..(31): Escherichia coli O139:H28 (strain E24377A/ETEC) A7ZP28 NAPA ECO24
MKLSRRSFMKANAVAAAAAAAGLSVPGVARA

SEQ ID NO: 1768 - protein, 31 aa, Escherichia coli
  misc feature (1)..(31): Escherichia coli (strain ATCC 8739/DSM 1576/Crooks) B1ISQ5 B1ISQ5 ECOLC
MGSPSLYSARKTTLALAVALSFAWQAPVFAH

SEQ ID NO: 1769 - protein, 31 aa, Escherichia coli
  misc feature (1)..(31): Escherichia coli (strain K12) P46923 TORZ ECOLI
MTLTRREFIKHSGIAAGALVVTSAAPLPAWA

SEQ ID NO: 1770 - protein, 31 aa, Escherichia coli
  misc feature (1)..(31): Escherichia coli (strain ATCC 8739/DSM 1576/Crooks) B1IYE0 B1IYE0 ECOLC
MKMLRDPLFWLIALFVALIFWLPYSQPLFAA

SEQ ID NO: 1771 - protein, 31 aa, Escherichia coli; identical to SEQ ID NO: 1761
  misc feature (1)..(31): Escherichia coli (strain K12) P75780 FIU ECOLI

SEQ ID NO: 1772 - protein, 31 aa, Escherichia coli
  misc feature (1)..(31): Escherichia coli (strain K12) P75830 MACA ECOLI
MKKRKTVKKRYVIALVIVIAGLITLWRILNA

SEQ ID NO: 1773 - protein, 31 aa, Escherichia coli
  misc feature (1)..(31): Escherichia coli (strain K12) P63883 AMIC ECOLI
MSGSNTAISRRRLLQGAGAMWLLSVSQVSLA

SEQ ID NO: 1774 - protein, 31 aa, Escherichia coli; identical to SEQ ID NO: 1773
  misc feature (1)..(31): Escherichia coli O6 P63884 AMIC ECOL6

SEQ ID NO: 1775 - protein, 31 aa, Escherichia coli
  misc feature (1)..(31): Escherichia coli (strain ATCC 8739/DSM 1576/Crooks) B1IQI8 B1IQI8 ECOLC
MSGLPLISRRRLLTAMALSPLLWQMNTAHAA

SEQ ID NO: 1776 - protein, 31 aa, Escherichia coli; identical to SEQ ID NO: 1772
  misc feature (1)..(31): Escherichia coli (strain ATCC 8739/DSM 1576/Crooks) B1IWP4 B1IWP4 ECOLC

SEQ ID NO: 1777 - protein, 31 aa, Escherichia coli
  misc feature (1)..(31): Escherichia coli (strain ATCC 8739/DSM 1576/Crooks) B1IW05 B1IW05 ECOLC
MDKFDANRRKLLALGGVALGAAILPTPAFAT

SEQ ID NO: 1778 - protein, 31 aa, Escherichia coli; identical to SEQ ID NO: 1761
  misc feature (1)..(31): Escherichia coli O157:H7 Q8X7W7 FIU ECO57

SEQ ID NO: 1779 - protein, 31 aa, Escherichia coli; identical to SEQ ID NO: 1767
  misc feature (1)..(31): Escherichia coli O1:K1/APEC A1AD59 NAPA ECOK1

SEQ ID NO: 1780 - protein, 31 aa, Escherichia coli
  misc feature (1)..(31): Escherichia coli (strain ATCC 8739/DSM 1576/Crooks) B1IWF7 B1IWF7 ECOLC
MKLNATYIKIRDKWWGLPLFLPSLILPIFAH

SEQ ID NO: 1781 - protein, 31 aa, Escherichia coli; identical to SEQ ID NO: 1767
  misc feature (1)..(31): Escherichia coli O9:H4 (strain HS) A8A268 NAPA ECOHS

SEQ ID NO: 1782 - protein, 31 aa, Escherichia coli
  misc feature (1)..(31): Escherichia coli (strain ATCC 8739/DSM 1576/Crooks) B1ISX4 B1ISX4 ECOLC
MIKRNLPLMITIGVFVLGYLYCLTQFPGFAS

SEQ ID NO: 1783 - protein, 31 aa, Escherichia coli
  misc feature (1)..(31): Escherichia coli (strain K12) Q9JMR5 YUBH ECOLI
MCCVYRMNRPASGLTVVFCGKLSGKPGPKSA

SEQ ID NO: 1784 - protein, 31 aa, Escherichia coli
  misc feature (1)..(31): Escherichia coli (strain ATCC 8739/DSM 1576/Crooks) B1IS07 B1IS07 ECOLC
MHLRHLFSSRLRGSLLLGSLLVASSFSTQAA

SEQ ID NO: 1785 - protein, 31 aa, Escherichia coli; identical to SEQ ID NO: 1772
  misc feature (1)..(31): Escherichia coli O157:H7 P64176 MACA ECO57

SEQ ID NO: 1786 - protein, 31 aa, Escherichia coli; identical to SEQ ID NO: 1761
  misc feature (1)..(31): Escherichia coli (strain UTI89/UPEC) Q1REC0 FIU ECOUT

SEQ ID NO: 1787 - protein, 31 aa, Escherichia coli; identical to SEQ ID NO: 1767
  misc feature (1)..(31): Escherichia coli (strain ATCC 8739/DSM 1576/Crooks) B1IY66 NAPA ECOLC

SEQ ID NO: 1788 - protein, 31 aa, Escherichia coli
  misc feature (1)..(31): Escherichia coli (strain ATCC 8739/DSM 1576/Crooks) B1IP61 B1IP61 ECOLC
MRRLRFSPRSSFARTLLLIVTLLFASLVTTY

SEQ ID NO: 1789 - protein, 31 aa, Escherichia coli
  misc feature (1)..(31): Escherichia coli O6 Q8CVZ3 TORZ ECOL6
MTLTRREFIKHSGIAAGTLVVTSAAPLPAWA

SEQ ID NO: 1790 - protein, 31 aa, Escherichia coli; identical to SEQ ID NO: 1769
  misc feature (1)..(31): Escherichia coli O157:H7 P58362 TORZ ECO57

SEQ ID NO: 1791 - protein, 31 aa, Escherichia coli
  misc feature (1)..(31): Escherichia coli (strain ATCC 8739/DSM 1576/Crooks) B1IT64 B1IT64 ECOLC
MPDAKKQGRSNKAMTFFVCFLAALAGLLFGL

SEQ ID NO: 1792 - protein, 31 aa, Escherichia coli
  misc feature (1)..(31): Escherichia coli (strain ATCC 8739/DSM 1576/Crooks) B1IVS1 B1IVS1 ECOLC
MKRWPVFPRSLRQLVMLAFLLILLPLLVLAW

SEQ ID NO: 1793 - protein, 31 aa, Escherichia coli
  misc feature (1)..(31): Escherichia coli (strain ATCC 8739/DSM 1576/Crooks) B1ISU9 B1ISU9 ECOLC
MNRLFSGRSDMPFALLLLAPSLLLLGGLVAW

SEQ ID NO: 1794 - protein, 31 aa, Escherichia coli
  misc feature (1)..(31): Escherichia coli (strain ATCC 8739/DSM 1576/Crooks) B1IZP6 B1IZP6 ECOLC
MIIKKSGGRWQLSLLASVVISAFFLNTAYAW

SEQ ID NO: 1795 - protein, 31 aa, Escherichia coli
  misc feature (1)..(31): Escherichia coli (strain ATCC 8739/DSM 1576/Crooks) B1IRA8 B1IRA8 ECOLC
MIWIMTMARRMNGVYAAFMLVAFMMGVAGAL

SEQ ID NO: 1796 - protein, 32 aa, Escherichia coli
  misc feature (1)..(32): Escherichia coli (strain ATCC 8739/DSM 1576/Crooks) B1IVS2 B1IVS2 ECOLC
MRHIFQRLLPRRLWLAGLPCLALLGCVQNHNK

SEQ ID NO: 1797 - protein, 32 aa, Escherichia coli
  misc feature (1)..(32): Escherichia coli (strain ATCC 8739/DSM 1576/Crooks) B1IYM8 B1IYM8 ECOLC
MKHPLETLTTAAGILLMAFLSCLLLPAPALGL

SEQ ID NO: 1798 - protein, 32 aa, Escherichia coli
  misc feature (1)..(32): Escherichia coli O157:H7 Q8X9V1 OPGD ECO57
MDRRRFIKGSMAMAAVCGTSGIASLFSQAAFA

SEQ ID NO: 1799 - protein, 32 aa, Escherichia coli; identical to SEQ ID NO: 1798
  misc feature (1)..(32): Escherichia coli O1:K1/APEC A1AB32 OPGD ECOK1

SEQ ID NO: 1800 - protein, 32 aa, Escherichia coli
  misc feature (1)..(32): Escherichia coli (strain ATCC 8739/DSM 1576/Crooks) B1IYU5 B1IYU5 ECOLC
MKFIGKLLLYILIALLVAIAGLYFLLQTRWGA

SEQ ID NO: 1801 - protein, 32 aa, Escherichia coli
  misc feature (1)..(32): Escherichia coli (strain ATCC 8739/DSM 1576/Crooks) B1IQY5 B1IQY5 ECOLC
MEKKLGLSALTALVLSSMLGAGVFSLPQNMAA

SEQ ID NO: 1802 - protein, 32 aa, Escherichia coli; identical to SEQ ID NO: 1798
  misc feature (1)..(32): Escherichia coli (strain K12) P40120 OPGD ECOLI

SEQ ID NO: 1803 - protein, 32 aa, Escherichia coli
  misc feature (1)..(32): Escherichia coli (strain ATCC 8739/DSM 1576/Crooks) B1ITD6 B1ITD6 ECOLC
MSAGRLNKKSLGIVMLLSVGLLLAGCSGSKSS

SEQ ID NO: 1804 - protein, 32 aa, Escherichia coli
  misc feature (1)..(32): Escherichia coli (strain ATCC 8739/DSM 1576/Crooks) B1IU27 B1IU27 ECOLC
MSGSNTAISRRRLLQGAGAMWLLSVSQVSLAA

SEQ ID NO: 1805 - protein, 32 aa, Escherichia coli; identical to SEQ ID NO: 1798
  misc feature (1)..(32): Escherichia coli (strain UTI89/UPEC) Q1RBZ1 OPGD ECOUT

SEQ ID NO: 1806 - protein, 32 aa, Escherichia coli
  misc feature (1)..(32): Escherichia coli (strain ATCC 8739/DSM 1576/Crooks) B1IYT1 B1IYT1 ECOLC
MQKTATTPSKILDLTAAAFLLVAFLTGIAGAL

SEQ ID NO: 1807 - protein, 32 aa, Escherichia coli
  misc feature (1)..(32): Escherichia coli (strain ATCC 8739/DSM 1576/Crooks) B1IYJ5 B1IYJ5 ECOLC
MSSTPIMKAFWRNAALLAVSLLPFSSANALAL

SEQ ID NO: 1808 - protein, 32 aa, Escherichia coli
  misc feature (1)..(32): Escherichia coli (strain K12) P75982 YMFQ ECOLI
MDVTNDDYIRLLSALLPPGPVWSASDPAIAGA

SEQ ID NO: 1809 - protein, 32 aa, Escherichia coli
  misc feature (1)..(32): Escherichia coli (strain ATCC 8739/DSM 1576/Crooks) B1IXF5 B1IXF5 ECOLC
MPGSLRKMPIWLPIVILLVAMASIQGGASLAK

SEQ ID NO: 1810 - protein, 32 aa, Escherichia coli
  misc feature (1)..(32): Escherichia coli (strain ATCC 8739/DSM 1576/Crooks) B1IXT5 B1IXT5 ECOLC
MLAFCRSSLKSKKYIIILLALAAIAGLGTHAA

SEQ ID NO: 1811 - protein, 32 aa, Escherichia coli
  misc feature (1)..(32): Escherichia coli (strain ATCC 8739/DSM 1576/Crooks) B1IRM4 B1IRM4 ECOLC
MRKIKGLRWYMIALVTLGTVLGYLTRNTVAAA

SEQ ID NO: 1812 - protein, 32 aa, Escherichia coli
  misc feature (1)..(32): Escherichia coli (strain ATCC 8739/DSM 1576/Crooks) B1J0L6 B1J0L6 ECOLC
MTLTRREFIKHSGIAAGALVVTSAAPLPAWAE

SEQ ID NO: 1813 - protein, 32 aa, Escherichia coli
  misc feature (1)..(32): Escherichia coli (strain ATCC 8739/DSM 1576/Crooks) B1IUP4 B1IUP4 ECOLC
MRFMQRSKDSLAKWLSAILPVVIVGLVGLFAV

SEQ ID NO: 1814 - protein, 32 aa, Escherichia coli
  misc feature (1)..(32): Escherichia coli (strain ATCC 8739/DSM 1576/Crooks) B1J071 B1J071 ECOLC
MFKSFFPKPGAFFLSAFVWALIAVIFWQAGGG

SEQ ID NO: 1815 - protein, 32 aa, Escherichia coli
  misc feature (1)..(32): Escherichia coli (strain ATCC 8739/DSM 1576/Crooks) B1ISH1 B1ISH1 ECOLC
MKLVEHYIMRGTRRLVLIIVGFLIFIFASYSA

SEQ ID NO: 1816 - protein, 32 aa, Escherichia coli
  misc feature (1)..(32): Escherichia coli (strain ATCC 8739/DSM 1576/Crooks) B1IXI0 B1IXI0 ECOLC
MSKSHPRWRLAKKILTWLFFIAVIVLLVVYAK

SEQ ID NO: 1817 - protein, 32 aa, Escherichia coli
  misc feature (1)..(32): Escherichia coli (strain ATCC 8739/DSM 1576/Crooks) B1IP39 B1IP39 ECOLC
MMNIIRLYIYPLFLGFVIVPLLVWPMVVALAA

SEQ ID NO: 1818 - protein, 32 aa, Escherichia coli
  misc feature (1)..(32): Escherichia coli (strain ATCC 8739/DSM 1576/Crooks) B1IUV6 B1IUV6 ECOLC
MSAISLINSGVAWFVAAAVLAFLFSFQKALSG

SEQ ID NO: 1819 - protein, 32 aa, Escherichia coli
  misc feature (1)..(32): Escherichia coli (strain ATCC 8739/DSM 1576/Crooks) B1ITT6 B1ITT6 ECOLC
MRHSLPYRMLRKRPMKLSTTVILMVSAVLFSV

SEQ ID NO: 1820 - protein, 32 aa, Escherichia coli
  misc feature (1)..(32): Escherichia coli (strain K12) P0ABL1 NRFB ECOLI
MSVLRSLLTAGVLASGLLWSLNGITATPAAQA

SEQ ID NO: 1821 - protein, 32 aa, Escherichia coli
  misc feature (1)..(32): Escherichia coli (strain ATCC 8739/DSM 1576/Crooks) B1IZD7 B1IZD7 ECOLC
MRTRHLVGLISGVLILSVLLPVGLSIWLAHQQ

SEQ ID NO: 1822 - protein, 32 aa, Escherichia coli
  misc feature (1)..(32): Escherichia coli (strain ATCC 8739/DSM 1576/Crooks) B1IQU9 B1IQU9 ECOLC
MTVFNKFARSFKSHWLLYLCVIVFGITNLVAS

SEQ ID NO: 1823 - protein, 32 aa, Escherichia coli
  misc feature (1)..(32): Escherichia coli (strain ATCC 8739/DSM 1576/Crooks) B1IUK2 B1IUK2 ECOLC
MLELLFVIGFFVMLMVTGVSLLGIIAALVVAT

SEQ ID NO: 1824 - protein, 32 aa, Escherichia coli
  misc feature (1)..(32): Escherichia coli (strain ATCC 8739/DSM 1576/Crooks) B1IQK1 B1IQK1 ECOLC
MYTLTHQKSRLPKTTLLAACCAFFYSSNGAAT

SEQ ID NO: 1825 - protein, 32 aa, Escherichia coli; identical to SEQ ID NO: 1798
  misc feature (1)..(32): Escherichia coli O139:H28 (strain E24377A/ETEC) A7ZLL8 OPGD ECO24

SEQ ID NO: 1826 - protein, 32 aa, Escherichia coli
  misc feature (1)..(32): Escherichia coli (strain ATCC 8739/DSM 1576/Crooks) B1IQI7 B1IQI7 ECOLC
MSKRIALFPALLLALLVIVATALTWMNFSQAL

SEQ ID NO: 1827 - protein, 32 aa, Escherichia coli
  misc feature (1)..(32): Escherichia coli (strain ATCC 8739/DSM 1576/Crooks) B1J0F3 B1J0F3 ECOLC
MLRYVLRRFLLLIPMVLAASVIIFLMLRLGTG

SEQ ID NO: 1828 - protein, 32 aa, Escherichia coli
  misc feature (1)..(32): Escherichia coli (strain ATCC 8739/DSM 1576/Crooks) B1IVU2 B1IVU2 ECOLC
MRRWISQNNIRLPRGAFFISALFFFNAVCIVS

SEQ ID NO: 1829 - protein, 32 aa, Escherichia coli; identical to SEQ ID NO: 1798
  misc feature (1)..(32): Escherichia coli O6 Q8CW34 OPGD ECOL6

SEQ ID NO: 1830 - protein, 32 aa, Escherichia coli; identical to SEQ ID NO: 1798
  misc feature (1)..(32): Escherichia coli O9:H4 (strain HS) A7ZZY2 OPGD ECOHS

SEQ ID NO: 1831 - protein, 32 aa, Escherichia coli; identical to SEQ ID NO: 1820
  misc feature (1)..(32): Escherichia coli O6 P0ABL2 NRFB ECOL6

SEQ ID NO: 1832 - protein, 32 aa, Escherichia coli
  misc feature (1)..(32): Escherichia coli (strain ATCC 8739/DSM 1576/Crooks) B1IZM9 B1IZM9 ECOLC
MKTSKTVAKLLFVVGALVYLVGLWISCPLLSG

SEQ ID NO: 1833 - protein, 33 aa, Escherichia coli
  misc feature (1)..(33): Escherichia coli (strain ATCC 8739/DSM 1576/Crooks) B1IPP7 B1IPP7 ECOLC
MMILSILATVVLLGALFYHRVSLFISSLILLAW

SEQ ID NO: 1834 - protein, 33 aa, Escherichia coli
  misc feature (1)..(33): Escherichia coli (strain K12) Q2MB16 YOBH ECOLI
MRFIIRTVMLIALVWIGLLLSGYGVLIGSKENA

SEQ ID NO: 1835 - protein, 33 aa, Escherichia coli
  misc feature (1)..(33): Escherichia coli (strain ATCC 8739/DSM 1576/Crooks) B1IYL6 B1IYL6 ECOLC
MSGSVAVTRAIAVPGLLLLLIIATALSLLIGAK

SEQ ID NO: 1836 - protein, 33 aa, Escherichia coli; identical to SEQ ID NO: 1834
  misc feature (1)..(33): Escherichia coli O6:K15:H31 (strain 536/UPEC) Q0TH06 YOBH ECOL5

SEQ ID NO: 1837 - protein, 33 aa, Escherichia coli
  misc feature (1)..(33): Escherichia coli (strain K12) P77338 KEFA ECOLI
MTMFQYYKRSRHFVFSAFIAFVFVLLCQNTAFA

SEQ ID NO: 1838 - protein, 33 aa, Escherichia coli
  misc feature (1)..(33): Escherichia coli (strain ATCC 8739/DSM 1576/Crooks) B1IXW9 B1IXW9 ECOLC
MKYLASFRTTLKASRYMFRALALVLWLLIAFSS

SEQ ID NO: 1839 - protein, 33 aa, Escherichia coli
  misc feature (1)..(33): Escherichia coli (strain ATCC 8739/DSM 1576/Crooks) B1IW90 B1IW90 ECOLC
MAHQLLIGKGMITLNLKRIFLALTLLPLFAVAA

SEQ ID NO: 1840 - protein, 33 aa, Escherichia coli
  misc feature (1)..(33): Escherichia coli (strain ATCC 8739/DSM 1576/Crooks) B1IYN8 B1IYN8 ECOLC
MVSKPFQRPFSLATRLTFFISLATIAAFFAFAW

SEQ ID NO: 1841 - protein, 33 aa, Escherichia coli
  misc feature (1)..(33): Escherichia coli (strain ATCC 8739/DSM 1576/Crooks) B1ISS9 B1ISS9 ECOLC
MIMAKLKSAKGKKFLFGLLAVFIIAASVVTRAT

SEQ ID NO: 1842 - protein, 33 aa, Escherichia coli
  misc feature (1)..(33): Escherichia coli (strain ATCC 8739/DSM 1576/Crooks) B1ISU8 B1ISU8 ECOLC
MATNKRTLSRIGFYCGLALFLIITLFPFFVMLM

SEQ ID NO: 1843 - protein, 33 aa, Escherichia coli
  misc feature (1)..(33): Escherichia coli (strain K12) P32176 FDOG ECOLI
MQVSRRQFFKICAGGMAGTTAAALGFAPSVALA

SEQ ID NO: 1844 - protein, 33 aa, Escherichia coli
  misc feature (1)..(33): Escherichia coli (strain K12) P06971 FHUA ECOLI
MARSKTAQPKHSLRKIAVVVATAVSGMSVYAQA

SEQ ID NO: 1845 - protein, 33 aa, Escherichia coli; identical to SEQ ID NO: 1834
  misc feature (1)..(33): Escherichia coli O6 Q8FGT6 YOBH ECOL6

SEQ ID NO: 1846 - protein, 33 aa, Escherichia coli
  misc feature (1)..(33): Escherichia coli (strain K12) P24183 FDNG ECOLI
MDVSRRQFFKICAGGMAGTTVAALGFAPKQALA

SEQ ID NO: 1847 - protein, 33 aa, Escherichia coli
  misc feature (1)..(33): Escherichia coli (strain ATCC 8739/DSM 1576/Crooks) B1IV74 B1IV74 ECOLC
MYSSSRKRCPKTKWALKLLTAAFLAASPAAKSA

SEQ ID NO: 1848 - protein, 33 aa, Escherichia coli
  misc feature (1)..(33): Escherichia coli (strain ATCC 8739/DSM 1576/Crooks) B1IYS1 B1IYS1 ECOLC
MKTLFSRLITVIACFFIFSAAWFCLWSISLHLV

SEQ ID NO: 1849 - protein, 33 aa, Escherichia coli
  misc feature (1)..(33): Escherichia coli (strain ATCC 8739/DSM 1576/Crooks) B1IPQ7 B1IPQ7 ECOLC
MRFKISLTTRLSLIFSAVMLTVWWLSSFILIST

SEQ ID NO: 1850 - protein, 33 aa, Escherichia coli
  misc feature (1)..(33): Escherichia coli (strain ATCC 8739/DSM 1576/Crooks) B1IYF2 B1IYF2 ECOLC
MSASSVKPLNVQLPAITLILFALCVGIFCYLAQ

SEQ ID NO: 1851 - protein, 33 aa, Escherichia coli
  misc feature (1)..(33): Escherichia coli (strain ATCC 8739/DSM 1576/Crooks) B1IY47 B1IY47 ECOLC
MRTFSGKRSTLALAIAGVTAMSGFMAMPEARAE

SEQ ID NO: 1852 - protein, 33 aa, Escherichia coli; identical to SEQ ID NO: 1834
  misc feature (1)..(33): Escherichia coli (strain UTI89/UPEC) Q1RAW1 YOBH ECOUT

SEQ ID NO: 1853 - protein, 33 aa, Escherichia coli
  misc feature (1)..(33): Escherichia coli (strain K12) P13036 FECA ECOLI
MTPLRVFRKTTPLVNTIRLSLLPLAGLSFSAFA

SEQ ID NO: 1854 - protein, 33 aa, Escherichia coli
  misc feature (1)..(33): Escherichia coli (strain ATCC 8739/DSM 1576/Crooks) B1IYA0 B1IYA0 ECOLC
MHNSPAVSSAKSFDLTSTAFLIVAFLTGIAGAL

SEQ ID NO: 1855 - protein, 33 aa, Escherichia coli
  misc feature (1)..(33): Escherichia coli (strain ATCC 8739/DSM 1576/Crooks) B1IVV3 B1IVV3 ECOLC
MSDMKSGNISMKAILIPFLSLLIPLTPQSAFAQ

SEQ ID NO: 1856 - protein, 33 aa, Escherichia coli
  misc feature (1)..(33): Escherichia coli (strain ATCC 8739/DSM 1576/Crooks) B1IUI0 B1IUI0 ECOLC
MSVLRSLLTAGVLASGLLWSLNGITATPAAQAS

SEQ ID NO: 1857 - protein, 33 aa, Escherichia coli; identical to SEQ ID NO: 1834
  misc feature (1)..(33): Escherichia coli O157:H7 Q8X4G6 YOBH ECO57

SEQ ID NO: 1858 - protein, 33 aa, Escherichia coli
  misc feature (1)..(33): Escherichia coli (strain ATCC 8739/DSM 1576/Crooks) B1IPR2 B1IPR2 ECOLC
MLLKTSRRTFLKGLTLSGVAGSLGVWSFNARSS

SEQ ID NO: 1859 - protein, 33 aa, Escherichia coli
  misc feature (1)..(33): Escherichia coli (strain K12) P77554 YAHJ ECOLI
MKESNSRREFLSQSGKMVTAAALFGTSVPLAHA

SEQ ID NO: 1860 - protein, 34 aa, Escherichia coli
  misc feature (1)..(34): Escherichia coli (strain ATCC 8739/DSM 1576/Crooks) B1IRF6 B1IRF6 ECOLC
MKHLHRFFSSDASGGIILIIAAILAMMMANSGAT

SEQ ID NO: 1861 - protein, 34 aa, Escherichia coli
  misc feature (1)..(34): Escherichia coli (strain ATCC 8739/DSM 1576/Crooks) B1IZC9 B1IZC9 ECOLC
MTMFQYYKRSRHFVFSAFIAFVFVLLCQNTAFAR

SEQ ID NO: 1862 - protein, 34 aa, Escherichia coli
  misc feature (1)..(34): Escherichia coli (strain ATCC 8739/DSM 1576/Crooks) B1IUD8 B1IUD8 ECOLC
MKKLLRLFFPLSLRVRFLLATAAVVLVLSLAYGM

SEQ ID NO: 1863 - protein, 34 aa, Escherichia coli
  misc feature (1)..(34): Escherichia coli (strain ATCC 8739/DSM 1576/Crooks) B1ITM8 B1ITM8 ECOLC
MLKRCLSPLTLVNQVALIVLLSTAIGLAGMAVSG

SEQ ID NO: 1864 - protein, 34 aa, Escherichia coli
  misc feature (1)..(34): Escherichia coli (strain ATCC 8739/DSM 1576/Crooks) B1IQ65 B1IQ65 ECOLC
MSQNKAFSTPFILAVLCIYFSYFLHGISVITLAQ

SEQ ID NO: 1865 - protein, 34 aa, Escherichia coli
  misc feature (1)..(34): Escherichia coli (strain ATCC 8739/DSM 1576/Crooks) B1J088 B1J088 ECOLC
MSTRTPSSSSSRLMLTIGLCFLVALMEGLDLQAA

SEQ ID NO: 1866 - protein, 34 aa, Escherichia coli
  misc feature (1)..(34): Escherichia coli (strain ATCC 8739/DSM 1576/Crooks) B1IRY4 B1IRY4 ECOLC
MDVSRRQFFKICAGGMAGTTVAALGFAPKQALAQ

SEQ ID NO: 1867 - protein, 34 aa, Escherichia coli
  misc feature (1)..(34): Escherichia coli (strain ATCC 8739/DSM 1576/Crooks) B1IRS0 B1IRS0 ECOLC
MYKKLKLTTISELIKNIYCSLSVIIIGCASAYAV

SEQ ID NO: 1868 - protein, 34 aa, Escherichia coli
  misc feature (1)..(34): Escherichia coli (strain ATCC 8739/DSM 1576/Crooks) B1IXG3 B1IXG3 ECOLC
MENNRNFPARQFHSLTFFAGLCIGITPVAQALAA

SEQ ID NO: 1869 - protein, 34 aa, Escherichia coli
  misc feature (1)..(34): Escherichia coli (strain ATCC 8739/DSM 1576/Crooks) B1J0R2 B1J0R2 ECOLC
MRFIIRTVMLIALVWIGLLLSGYGVLIGSKENAA

SEQ ID NO: 1870 - protein, 34 aa, Escherichia coli
  misc feature (1)..(34): Escherichia coli (strain ATCC 8739/DSM 1576/Crooks) B1IX94 B1IX94 ECOLC
MEQINSNKKHSNRRKYFSLLAVVLFIAFSGAYAY

SEQ ID NO: 1871 - protein, 34 aa, Escherichia coli
  misc feature (1)..(34): Escherichia coli (strain ATCC 8739/DSM 1576/Crooks) B1IS88 B1IS88 ECOLC
MLKVMNKLIELRRAKMLALSLLLTAVATFIVTLF

SEQ ID NO: 1872 - protein, 34 aa, Escherichia coli
  misc feature (1)..(34): Escherichia coli (strain ATCC 8739/DSM 1576/Crooks) B1ISJ9 B1ISJ9 ECOLC
MTPLRVFRKTTPLVNAIRLSLLPLAGLSFSAFAA

SEQ ID NO: 1873 - protein, 34 aa, Escherichia coli
  misc feature (1)..(34): Escherichia coli (strain ATCC 8739/DSM 1576/Crooks) B1IQJ0 B1IQJ0 ECOLC
MARSKTAQPKHSLRKIAVVVATAVSGMSVYAQAA

SEQ ID NO: 1874 - protein, 34 aa, Escherichia coli
  misc feature (1)..(34): Escherichia coli (strain ATCC 8739/DSM 1576/Crooks) B1ISI4 B1ISI4 ECOLC
MVTWTQMYMPMGGLGLSALVALIPIIFFFVALAV

SEQ ID NO: 1875 - protein, 34 aa, Escherichia coli
  misc feature (1)..(34): Escherichia coli (strain ATCC 8739/DSM 1576/Crooks) B1J0V3 B1J0V3 ECOLC
MKESNSRREFLSQSGKMVTAAALFGTSVPLAHAA

SEQ ID NO: 1876 - protein, 34 aa, Escherichia coli
  misc feature (1)..(34): Escherichia coli (strain ATCC 8739/DSM 1576/Crooks) B1IZ98 B1IZ98 ECOLC
MIARWFWREWRSPSLLIVWLALSLAVACVLALGN

SEQ ID NO: 1877 - protein, 34 aa, Escherichia coli
  misc feature (1)..(34): Escherichia coli (strain ATCC 8739/DSM 1576/Crooks) B1IZ12 B1IZ12 ECOLC
MMKSKMKLMPLLVSVTLISGCTVLPGSNMSTMGK

SEQ ID NO: 1878 - protein, 34 aa, Escherichia coli
  misc feature (1)..(34): Escherichia coli (strain ATCC 8739/DSM 1576/Crooks) B1IYD0 B1IYD0 ECOLC
MNRDSFYPAIACFPLLLMLAGCAPMHETRQALSQ

SEQ ID NO: 1879 - protein, 34 aa, Escherichia coli
  misc feature (1)..(34): Escherichia coli (strain ATCC 8739/DSM 1576/Crooks) B1IVI4 B1IVI4 ECOLC
MQVSRRQFFKICAGGMAGTTAAALGFAPSVALAE

SEQ ID NO: 1880 - protein, 34 aa, Escherichia coli
  misc feature (1)..(34): Escherichia coli (strain K12) P36548 AMIA ECOLI
MSTFKPLKTLTSRRQVLKAGLAALTLSGMSQAIA

SEQ ID NO: 1881 - protein, 34 aa, Escherichia coli
  misc feature (1)..(34): Escherichia coli Q05433 CLPE ECOLX
MSKRNAVTTFFTNRVTKALGMTLALMMTCQSAMA

SEQ ID NO: 1882 - protein, 34 aa, Escherichia coli
  misc feature (1)..(34): Escherichia coli (strain ATCC 8739/DSM 1576/Crooks) B1IPE1 B1IPE1 ECOLC
MTCSTSLSGKNRIVLIAGILMIATTLRVTFTGAA

SEQ ID NO: 1883 - protein, 34 aa, Escherichia coli; identical to SEQ ID NO: 1881
  misc feature (1)..(34): Escherichia coli P25401 FAEE ECOLX

SEQ ID NO: 1884 - protein, 34 aa, Escherichia coli
  misc feature (1)..(34): Escherichia coli (strain ATCC 8739/DSM 1576/Crooks) B1ITQ7 B1ITQ7 ECOLC
MSGLKQELGLAQGIGLLSTSLLGTGVFAVPALAA

SEQ ID NO: 1885 - protein, 34 aa, Escherichia coli
  misc feature (1)..(34): Escherichia coli (strain ATCC 8739/DSM 1576/Crooks) B1ISI5 B1ISI5 ECOLC
MNKKFKYKKSLLAAILSATLLAGCDGGGSGSSSD

SEQ ID NO: 1886 - protein, 35 aa, Escherichia coli
  misc feature (1)..(35): Escherichia coli (strain ATCC 8739/DSM 1576/Crooks) B1IS63 B1IS63 ECOLC
MLKRIKIVTSLLLVLAVFGLLQLTSGGLFFNALKN

SEQ ID NO: 1887 - protein, 35 aa, Escherichia coli
  misc feature (1)..(35): Escherichia coli P06970 FAED ECOLX
MKKYVTTKSVQPVAFRLTTLSLVMSAVLGSASVIA

SEQ ID NO: 1888 - protein, 35 aa, Escherichia coli
  misc feature (1)..(35): Escherichia coli O6 Q8CW71 YCDB ECOL6
MQYEDENGVNEPSRRRLLKGIGALALAGSCPVAHA

SEQ ID NO: 1889 - protein, 35 aa, Escherichia coli
  misc feature (1)..(35): Escherichia coli (strain K12) P31545 YCDB ECOLI
MQYKDENGVNEPSRRRLLKVIGALALAGSCPVAHA

SEQ ID NO: 1890 - protein, 35 aa, Escherichia coli
  misc feature (1)..(35): Escherichia coli (strain K12) P77468 SFMD ECOLI
MKIPTTTDIPQRYTWCLAGICYSSLAILPSFLSYA

SEQ ID NO: 1891 - protein, 35 aa, Escherichia coli
  misc feature (1)..(35): Escherichia coli (strain K12) P75857 YCBS ECOLI
MYRTHRQHSLLSSGGVPSFIGGLVVFVSAAFNAQA

SEQ ID NO: 1892 - protein, 35 aa, Escherichia coli; identical to SEQ ID NO: 1888
  misc feature (1)..(35): Escherichia coli O1:K1/APEC A1A9S3 YCDB ECOK1

SEQ ID NO: 1893 - protein, 35 aa, Escherichia coli
  misc feature (1)..(35): Escherichia coli (strain ATCC 8739/DSM 1576/Crooks) B1IUJ0 B1IUJ0 ECOLC
MSHRARHQLLALPGIIFLVLFPIILSLWIAFLWAK

SEQ ID NO: 1894 - protein, 35 aa, Escherichia coli
  misc feature (1)..(35): Escherichia coli (strain ATCC 8739/DSM 1576/Crooks) B1ISN4 B1ISN4 ECOLC
MITERRNVLLQGAGWLLLLAPFFFFTYGSLNQFTA

SEQ ID NO: 1895 - protein, 35 aa, Escherichia coli
  misc feature (1)..(35): Escherichia coli (strain ATCC 8739/DSM 1576/Crooks) B1IZH7 B1IZH7 ECOLC
MTRAVKPRRFAIRPIIYASVLSAGVLLCAFSAHAD

SEQ ID NO: 1896 - protein, 35 aa, Escherichia coli
  misc feature (1)..(35): Escherichia coli (strain ATCC 8739/DSM 1576/Crooks) B1IPW8 B1IPW8 ECOLC
MINRQQGFTLLEVMAALAIFSMLSVLAFMIFSQAS

SEQ ID NO: 1897 - protein, 35 aa, Escherichia coli
  misc feature (1)..(35): Escherichia coli (strain ATCC 8739/DSM 1576/Crooks) B1ISR0 B1ISR0 ECOLC
MLGKYKAVLALLLLIILVPLTLLMTLGLWVPTLAG

SEQ ID NO: 1898 - protein, 35 aa, Escherichia coli
  misc feature (1)..(35): Escherichia coli (strain ATCC 8739/DSM 1576/Crooks) B1IX37 B1IX37 ECOLC
MSTFKPLKTLTSRRQVLKAGLAALTLSGMSQAIAK

SEQ ID NO: 1899 - protein, 35 aa, Escherichia coli
  misc feature (1)..(35): Escherichia coli (strain ATCC 8739/DSM 1576/Crooks) B1IW77 B1IW77 ECOLC
MIEVKHLKTLQALRNCGSLAAAAATLHQTQSALSH

SEQ ID NO: 1900 - protein, 35 aa, Escherichia coli
  misc feature (1)..(35): Escherichia coli (strain ATCC 8739/DSM 1576/Crooks) B1ISH2 B1ISH2 ECOLC
MNVFSRYLIRHLFLGFAAAAGLLLPLFTTFNLINE

SEQ ID NO: 1901 - protein, 35 aa, Escherichia coli; identical to SEQ ID NO: 1888
  misc feature (1)..(35): Escherichia coli (strain UTI89/UPEC) Q1RDJ8 YCDB ECOUT

SEQ ID NO: 1902 - protein, 35 aa, Escherichia coli
  misc feature (1)..(35): Escherichia coli O157:H7 O82882 STCE ECO57
MNTKMNERWRTPMKLKYLSCTILAPLAIGVFSATA

SEQ ID NO: 1903 - protein, 35 aa, Escherichia coli
  misc feature (1)..(35): Escherichia coli O157:H7 Q8XAS4 YCDB ECO57
MQYEDKNGVNEPSRRRLLKGIGALALAGSCPVAHA

SEQ ID NO: 1904 - protein, 35 aa, Escherichia coli
  misc feature (1)..(35): Escherichia coli (strain ATCC 8739/DSM 1576/Crooks) B1ISD0 B1ISD0 ECOLC
MKFTQRLSLRVRLTLIFLILASVTWLLSSFVAWKQ

SEQ ID NO: 1905 - protein, 35 aa, Escherichia coli
  misc feature (1)..(35): Escherichia coli (strain ATCC 8739/DSM 1576/Crooks) B1IWJ0 B1IWJ0 ECOLC
MANFFIDRPIFAWVLAILLCLTGTLAIFSLPVEQY

SEQ ID NO: 1906 - protein, 35 aa, Escherichia coli; identical to SEQ ID NO: 1888
  misc feature (1)..(35): Escherichia coli O6:K15:H31 (strain 536/UPEC) Q0TJ48 YCDB ECOL5

SEQ ID NO: 1907 - protein, 36 aa, Escherichia coli
  misc feature (1)..(36): Escherichia coli (strain K12) P33937 NAPA ECOLI
MKLSRRSFMKANAVAAAAAAAGLSVPGVARAVVGQQ

SEQ ID NO: 1908 - protein, 36 aa, Escherichia coli; identical to SEQ ID NO: 1907
  misc feature (1)..(36): Escherichia coli O157:H7 Q8XE47 NAPA ECO57

SEQ ID NO: 1909 - protein, 36 aa, Escherichia coli
  misc feature (1)..(36): Escherichia coli (strain K12) P16869 FHUE ECOLI
MLSTQFNRDNQYQAITKPSLLAGCIALALLPSAAFA

SEQ ID NO: 1910 - protein, 36 aa, Escherichia coli
  misc feature (1)..(36): Escherichia coli (strain ATCC 8739/DSM 1576/Crooks) B1IVE9 B1IVE9 ECOLC
MTEQQISRTQAWLESLRPKTLPLAFAAIIVGTALAW

SEQ ID NO: 1911 - protein, 36 aa, Escherichia coli
  misc feature (1)..(36): Escherichia coli (strain ATCC 8739/DSM 1576/Crooks) B1IUE7 B1IUE7 ECOLC
MPLSLLIGLRFSRGRRRGGMVSLISVISTIGIALGV

SEQ ID NO: 1912 - protein, 36 aa, Escherichia coli
  misc feature (1)..(36): Escherichia coli (strain ATCC 8739/DSM 1576/Crooks) B1IZ69 B1IZ69 ECOLC
MKIPTTTDIPQRYTWCLAGICYSSLAILPSFLSYAE

SEQ ID NO: 1913 - protein, 36 aa, Escherichia coli
  misc feature (1)..(36): Escherichia coli (strain ATCC 8739/DSM 1576/Crooks) B1IV79 B1IV79 ECOLC
MQYKDENGVNEPSRRRLLKVIGALALAGSCPVAHAQ

SEQ ID NO: 1914 - protein, 36 aa, Escherichia coli
  misc feature (1)..(36): Escherichia coli (strain ATCC 8739/DSM 1576/Crooks) B1IXD6 B1IXD6 ECOLC
MLSLYEKIKIRLIILFLLAALSFIGLFFIINYQLVS

SEQ ID NO: 1915 - protein, 36 aa, Escherichia coli; identical to SEQ ID NO: 1907
  misc feature (1)..(36): Escherichia coli (strain UTI89/UPEC) Q1R9L3 NAPA ECOUT

SEQ ID NO: 1916 - protein, 36 aa, Escherichia coli; identical to SEQ ID NO: 1907
  misc feature (1)..(36): Escherichia coli O6:K15:H31 (strain 536/UPEC) Q0TFN6 NAPA ECOL5

SEQ ID NO: 1917 - protein, 36 aa, Escherichia coli
  misc feature (1)..(36): Escherichia coli O6 P59590 FIMC ECOL6
MSNKNVNVRKSQEITFCLLAGILMFMAMVVAGRAEA

SEQ ID NO: 1918 - protein, 36 aa, Escherichia coli
  misc feature (1)..(36): Escherichia coli (strain ATCC 8739/DSM 1576/Crooks) B1IY93 B1IY93 ECOLC
MFIRAPNFGRKLLLTCIVAGVMIAILVSCLQFLVAW

SEQ ID NO: 1919 - protein, 36 aa, Escherichia coli
  misc feature (1)..(36): Escherichia coli (strain ATCC 8739/DSM 1576/Crooks) B1ITX8 B1ITX8 ECOLC
MESTPKKAPRSKFPALLVVALALVALVFVIWRVDSA

SEQ ID NO: 1920 - protein, 36 aa, Escherichia coli; identical to SEQ ID NO: 1907
  misc feature (1)..(36): Escherichia coli O6 Q8CVW4 NAPA ECOL6

SEQ ID NO: 1921 - protein, 36 aa, Escherichia coli
  misc feature (1)..(36): Escherichia coli (strain ATCC 8739/DSM 1576/Crooks) B1IXW4 B1IXW4 ECOLC
MIGRISRFMTRFVSRWLPDPLIFAMLLTLLTFVIAL

SEQ ID NO: 1922 - protein, 36 aa, Escherichia coli
  misc feature (1)..(36): Escherichia coli (strain K12) P31697 FIMC ECOLI
MSNKNVNVRKSQEITFCLLAGILMFMAMMVAGRAEA

SEQ ID NO: 1923 - protein, 37 aa, Escherichia coli
  misc feature (1)..(37): Escherichia coli (strain ATCC 8739/DSM 1576/Crooks) B1IX48 B1IX48 ECOLC
MFAVSSRRVLPGFTLSLGTSLLFVCLILLLPLSALVM

SEQ ID NO: 1924 - protein, 37 aa, Escherichia coli
  misc feature (1)..(37): Escherichia coli (strain ATCC 8739/DSM 1576/Crooks) B1ISJ1 B1ISJ1 ECOLC
MIMSENDTIPKKSTSQINKAVFFTSALLIFLLVAFAA

SEQ ID NO: 1925 - protein, 37 aa, Escherichia coli
  misc feature (1)..(37): Escherichia coli (strain ATCC 8739/DSM 1576/Crooks) B1ITN0 B1ITN0 ECOLC
MVFHFLPEVTDVLSRFVPRIISFYLLLLAAGGTANAQ

SEQ ID NO: 1926 - protein, 37 aa, Escherichia coli
  misc feature (1)..(37): Escherichia coli (strain ATCC 8739/DSM 1576/Crooks) B1ISJ7 B1ISJ7 ECOLC
MTAIKHPVLLWGLPVAALIIIFWLSLFCYSAIPVSGA

SEQ ID NO: 1927 - protein, 37 aa, Escherichia coli
  misc feature (1)..(37): Escherichia coli (strain ATCC 8739/DSM 1576/Crooks) B1IV23 B1IV23 ECOLC
MIAMQKNAAHTYAISSLLVLSLTGCAWIPSTPLVQGA

SEQ ID NO: 1928 - protein, 37 aa, Escherichia coli
  misc feature (1)..(37): Escherichia coli (strain ATCC 8739/DSM 1576/Crooks) B1IUG3 B1IUG3 ECOLC
MLSTQFNRDNQYQAITKPSLLAGCIALALLPSAAFAA

SEQ ID NO: 1929 - protein, 37 aa, Escherichia coli
  misc feature (1)..(37): Escherichia coli (strain ATCC 8739/DSM 1576/Crooks) B1IR81 SECM ECOLC
MSGILTRWRQFGKRYFWPHLLLGMVAASLGLPALSNA

SEQ ID NO: 1930 - protein, 37 aa, Escherichia coli; identical to SEQ ID NO: 1929
  misc feature (1)..(37): Escherichia coli O1:K1/APEC A1A7E2 SECM ECOK1

SEQ ID NO: 1931 - protein, 37 aa, Escherichia coli
  misc feature (1)..(37): Escherichia coli (strain ATCC 8739/DSM 1576/Crooks) B1IUL9 B1IUL9 ECOLC
MAMVQPKSQKARLFITHLLLLLFIAAIMFPLLMVVAI

SEQ ID NO: 1932 - protein, 37 aa, Escherichia coli
  misc feature (1)..(37): Escherichia coli O157:H7 P69743 MBHT ECO57
MTGDNTLIHSHGINRRDFMKLCAALAATMGLSSKAAA

SEQ ID NO: 1933 - protein, 37 aa, Escherichia coli; identical to SEQ ID NO: 1929
  misc feature (1)..(37): Escherichia coli O6:K15:H31 (strain 536/UPEC) Q0TLP2 SECM ECOL5

SEQ ID NO: 1934 - protein, 37 aa, Escherichia coli; identical to SEQ ID NO: 1929
  misc feature (1)..(37): Escherichia coli O6 P62396 SECM ECOL6

SEQ ID NO: 1935 - protein, 37 aa, Escherichia coli; identical to SEQ ID NO: 1929
  misc feature (1)..(37): Escherichia coli (strain UTI89/UPEC) Q1RG98 SECM ECOUT

SEQ ID NO: 1936 - protein, 37 aa, Escherichia coli
  misc feature (1)..(37): Escherichia coli O85186 O85186 ECOLX
MSSAPMKATLLDCSTLYFTSNMKLFYLLGLLNGTALA

SEQ ID NO: 1937 - protein, 37 aa, Escherichia coli; identical to SEQ ID NO: 1932
  misc feature (1)..(37): Escherichia coli (strain K12) P69741 MBHT ECOLI

SEQ ID NO: 1938 - protein, 37 aa, Escherichia coli; identical to SEQ ID NO: 1929
  misc feature (1)..(37): Escherichia coli O157:H7 P62397 SECM ECO57

SEQ ID NO: 1939 - protein, 37 aa, Escherichia coli
  misc feature (1)..(37): Escherichia coli (strain ATCC 8739/DSM 1576/Crooks) B1J047 B1J047 ECOLC
MESKNKLKRGLSTRHIRFMALGSAIGTGLFYGSADAI

SEQ ID NO: 1940 - protein, 37 aa, Escherichia coli; identical to SEQ ID NO: 1932
  misc feature (1)..(37): Escherichia coli O6 P69742 MBHT ECOL6

SEQ ID NO: 1941 - protein, 37 aa, Escherichia coli; identical to SEQ ID NO: 1929
  misc feature (1)..(37): Escherichia coli (strain K12) P62395 SECM ECOLI

SEQ ID NO: 1942 - protein, 37 aa, Escherichia coli
  misc feature (1)..(37): Escherichia coli (strain ATCC 8739/DSM 1576/Crooks) B1IW11 B1IW11 ECOLC
MLFTLKKVIGNMLLPLPLMLLIIGAGLALLWFSRFQK

SEQ ID NO: 1943 - protein, 38 aa, Escherichia coli
  misc feature (1)..(38): Escherichia coli (strain ATCC 8739/DSM 1576/Crooks) B1ISF4 B1ISF4 ECOLC
MTGDNTLIHSHGINRRDFMKLCAALAATMGLSSKAAAE

SEQ ID NO: 1944 - protein, 38 aa, Escherichia coli
  misc feature (1)..(38): Escherichia coli O157:H7 Q8XE35 YFAS ECO57
MDTQRFQSQFHWHLSFKFSGAIAACLSLSLVGTGLANA

SEQ ID NO: 1945 - protein, 38 aa, Escherichia coli
  misc feature (1)..(38): Escherichia coli (strain ATCC 8739/DSM 1576/Crooks) B1J016 B1J016 ECOLC
MSSQYLRIFQQPRSAILLILGFASGLPLALTSGTLQAW

SEQ ID NO: 1946 - protein, 38 aa, Escherichia coli
  misc feature (1)..(38): Escherichia coli (strain ATCC 8739/DSM 1576/Crooks) B1IZE4 B1IZE4 ECOLC
MRSFSQLWPTLKRLLAYGSPWRKPLGIAVLMMWVAAAA

SEQ ID NO: 1947 - protein, 38 aa, Escherichia coli
  misc feature (1)..(38): Escherichia coli (strain ATCC 8739/DSM 1576/Crooks) B1J049 B1J049 ECOLC
MLERLSWKRLVLELLLCCLPAFILGAFFGYLPWFLLAS

SEQ ID NO: 1948 - protein, 38 aa, Escherichia coli
  misc feature (1)..(38): Escherichia coli P46009 FOCD ECOLX
MFFGDGGQLLSDKSLTGSAGGGNNRMKFNILPLAFFIG

SEQ ID NO: 1949 - protein, 38 aa, Escherichia coli; identical to SEQ ID NO: 1944
  misc feature (1)..(38): Escherichia coli (strain K12) P76464 YFAS ECOLI

SEQ ID NO: 1950 - protein, 38 aa, Escherichia coli
  misc feature (1)..(38): Escherichia coli (strain ATCC 8739/DSM 1576/Crooks) B1IUY9 B1IUY9 ECOLC
MSANAETQTPQQPVKKSGKRKRLLLLLTLLFIIIAVAI

SEQ ID NO: 1951 - protein, 39 aa, Escherichia coli
  misc feature (1)..(39): Escherichia coli (strain ATCC 8739/DSM 1576/Crooks) B1IYI7 B1IYI7 ECOLC
MLQLNENKQFAFFQRLAFPLRIFLLILVFSIFVIAALAQ

SEQ ID NO: 1952 - protein, 39 aa, Escherichia coli
  misc feature (1)..(39): Escherichia coli Q46678 Q46678 ECOLX
MSNPIYRSGKVIAEMIEMNKVIAVSALAMAGMFSTQALA

SEQ ID NO: 1953 - protein, 39 aa, Escherichia coli
  misc feature (1)..(39): Escherichia coli O157:H7 P58360 TORA ECO57
MNNNDLFQASRRRFLAQLGGLTVAGMLGPSLLTSRRATA

SEQ ID NO: 1954 - protein, 39 aa, Escherichia coli
  misc feature (1)..(39): Escherichia coli (strain ATCC 8739/DSM 1576/Crooks) B1IW17 B1IW17 ECOLC
MHNDKDLSTWQTFRRLWPTIAPFKAGLIVAGVALILNAA

SEQ ID NO: 1955 - protein, 39 aa, Escherichia coli
  misc feature (1)..(39): Escherichia coli (strain ATCC 8739/DSM 1576/Crooks) B1IP72 B1IP72 ECOLC
MNMFFDWWFATSPRLRQLCWAVWLLMLVTLIFLSSTHQE

SEQ ID NO: 1956 - protein, 39 aa, Escherichia coli
  misc feature (1)..(39): Escherichia coli (strain ATCC 8739/DSM 1576/Crooks) B1IQL6 B1IQL6 ECOLC
MAINNTGSRRLLVTLTALFAALCGLYLLIGGGWLVAIGG

SEQ ID NO: 1957 - protein, 39 aa, Escherichia coli
  misc feature (1)..(39): Escherichia coli O6 Q8CW73 TORA ECOL6
MNNNDLFQASRRRFLAQLGGLTVAGMLGTSLLTPRRATA

SEQ ID NO: 1958 - protein, 39 aa, Escherichia coli
  misc feature (1)..(39): Escherichia coli (strain ATCC 8739/DSM 1576/Crooks) B1IPS3 B1IPS3 ECOLC
MHSKPSRRPFSLALRLTFFISLSTILAFIAFTWFMLHSV

SEQ ID NO: 1959 - protein, 39 aa, Escherichia coli
  misc feature (1)..(39): Escherichia coli (strain K12) P33225 TORA ECOLI
MNNNDLFQASRRRFLAQLGGLTVAGMLGPSLLTPRRATA

SEQ ID NO: 1960 - protein, 40 aa, Escherichia coli
  misc feature (1)..(40): Escherichia coli (strain ATCC 8739/DSM 1576/Crooks) B1IVA0 B1IVA0 ECOLC
MNNNDLFQASRRRFLAQLGGLTVAGMLGPSLLTPRRATAA

SEQ ID NO: 1961 - protein, 40 aa, Escherichia coli
  misc feature (1)..(40): Escherichia coli (strain ATCC 8739/DSM 1576/Crooks) B1ISM5 B1ISM5 ECOLC
MNTTPSQRLGFLHHIRLVPLFACILGGILVLFALSSALAG

SEQ ID NO: 1962 - protein, 40 aa, Escherichia coli
  misc feature (1)..(40): Escherichia coli (strain ATCC 8739/DSM 1576/Crooks) B1IQC8 B1IQC8 ECOLC
MTTTTPQRIGGWLLGPLAWLLVALLSTTLALLLYTAALSS

SEQ ID NO: 1963 - protein, 40 aa, Escherichia coli
  misc feature (1)..(40): Escherichia coli (strain K12) P42915 YRAJ ECOLI
MPQRHHQGHKRTPKQLALIIKRCLPMVLTGSGMLCTTANA

SEQ ID NO: 1964 - protein, 40 aa, Escherichia coli
  misc feature (1)..(40): Escherichia coli (strain ATCC 8739/DSM 1576/Crooks) B1IPN0 B1IPN0 ECOLC
MNAQIKKLTQAFPAFRLRLADNKRWALMAGVGLAVAATAI

SEQ ID NO: 1965 - protein, 40 aa, Escherichia coli
  misc feature (1)..(40): Escherichia coli Q07685 Q07685 ECOLX
MAHSFYVNFGKKNIWRMSEMKKTFIASAIAITINTGSAIA

SEQ ID NO: 1966 - protein, 41 aa, Escherichia coli
  misc feature (1)..(41): Escherichia coli (strain ATCC 8739/DSM 1576/Crooks) B1IQX7 B1IQX7 ECOLC
MPQRHHQGHKRTPKQLALIIKRCLPMVLTGSGMLCTTANAE

SEQ ID NO: 1967 - protein, 41 aa, Escherichia coli
  misc feature (1)..(41): Escherichia coli O6 P0AAL4 NAPG ECOL6
MSRSAKPQNGRRRFLRDVVRTAGGLAAVGVALGLQQQTARA

SEQ ID NO: 1968 - protein, 41 aa, Escherichia coli
  misc feature (1)..(41): Escherichia coli (strain ATCC 8739/DSM 1576/Crooks) B1IRN1 B1IRN1 ECOLC
MQPRLLLRICFSRRTLKIGCLLLLIAGATIFIADRVMVNAS

SEQ ID NO: 1969 - protein, 41 aa, Escherichia coli
  misc feature (1)..(41): Escherichia coli (strain ATCC 8739/DSM 1576/Crooks) B1J0E6 B1J0E6 ECOLC
MRHLRNIFNLGIKELRSLLGDKAMLTLIVFSFTVSVYSSAT

SEQ ID NO: 1970 - protein, 41 aa, Escherichia coli
  misc feature (1)..(41): Escherichia coli (strain ATCC 8739/DSM 1576/Crooks) B1IVX5 B1IVX5 ECOLC
MLSRWRYSWRILDDNEAQKMKKTAIAIAVALAGFATVAQAA

SEQ ID NO: 1971 - protein, 41 aa, Escherichia coli
  misc feature (1)..(41): Escherichia coli (strain ATCC 8739/DSM 1576/Crooks) B1IXZ4 B1IXZ4 ECOLC
MSKIIATLYAVMDKRPLRALSFVMALLLAGCMFWDPSRFAA

SEQ ID NO: 1972 - protein, 41 aa, Escherichia coli
  misc feature (1)..(41): Escherichia coli Q47452 PCOA ECOLX
MLLKTSRRTFLKGLTLSGVAGSLGVWSFNARSSLSLPVAAS

SEQ ID NO: 1973 - protein, 41 aa, Escherichia coli
  misc feature (1)..(41): Escherichia coli (strain ATCC 8739/DSM 1576/Crooks) B1IYH4 B1IYH4 ECOLC
MTDNPNKKTFWDKVHLDPTMLLILLALLVYSALVIWSASGQ

SEQ ID NO: 1974 - protein, 41 aa, Escherichia coli
  misc feature (1)..(41): Escherichia coli (strain ATCC 8739/DSM 1576/Crooks) B1IYB1 B1IYB1 ECOLC
MTNITLQKQHRTLWHFIPGLALSAVITWVALWGGSIPAVAG

SEQ ID NO: 1975 - protein, 41 aa, Escherichia coli
  misc feature (1)..(41): Escherichia coli (strain ATCC 8739/DSM 1576/Crooks) B1IW50 B1IW50 ECOLC
MANLLNKFIMTRILAAITLLLSIVLTILVTIFCSVPIIIAG

SEQ ID NO: 1976 - protein, 41 aa, Escherichia coli
  misc feature (1)..(41): Escherichia coli (strain ATCC 8739/DSM 1576/Crooks) B1IWJ1 B1IWJ1 ECOLC
MIVKRPVSASLARAFFYIVLLSILSTGIALLTLASSLRDAE

SEQ ID NO: 1977 - protein, 41 aa, Escherichia coli; identical to SEQ ID NO: 1967
  misc feature (1)..(41): Escherichia coli (strain K12) P0AAL3 NAPG ECOLI

SEQ ID NO: 1978 - protein, 41 aa, Escherichia coli
  misc feature (1)..(41): Escherichia coli (strain ATCC 8739/DSM 1576/Crooks) B1IZW0 B1IZW0 ECOLC
MTPESVMMMGTEAMKVALALAAPLLLVALVTGLIISILQAA

SEQ ID NO: 1979 - protein, 41 aa, Escherichia coli
  misc feature (1)..(41): Escherichia coli (strain ATCC 8739/DSM 1576/Crooks) B1IY56 B1IY56 ECOLC
MRQKETTATTRFSLLPGSITRFFLLLIIVLLVTMGVMVQSA

SEQ ID NO: 1980 - protein, 42 aa, Escherichia coli
  misc feature (1)..(42): Escherichia coli (strain ATCC 8739/DSM 1576/Crooks) B1IVW2 B1IVW2 ECOLC
MDRIVSSSHDRTSLLSTHKVLRNTYFLLSLTLAFSAITATAS

SEQ ID NO: 1981 - protein, 42 aa, Escherichia coli
  misc feature (1)..(42): Escherichia coli (strain ATCC 8739/DSM 1576/Crooks) B1ITL3 B1ITL3 ECOLC
MLVNTSNYNEGVQKTMTNITKRSLVAAGVLAALMAGNVALAA

SEQ ID NO: 1982 - protein, 42 aa, Escherichia coli
  misc feature (1)..(42): Escherichia coli (strain ATCC 8739/DSM 1576/Crooks) B1IY67 B1IY67 ECOLC
MSRSAKPQNGRRRFLRDVVRTAGGLAAVGVALGLQQQTARAS

SEQ ID NO: 1983 - protein, 42 aa, Escherichia coli
  misc feature (1)..(42): Escherichia coli (strain ATCC 8739/DSM 1576/Crooks) B1IRY2 B1IRY2 ECOLC
MSKSKMIVRTKFIDRACHWTVVICFFLVALSGISFFFPTLQW

SEQ ID NO: 1984 - protein, 42 aa, Escherichia coli
  misc feature (1)..(42): Escherichia coli (strain ATCC 8739/DSM 1576/Crooks) B1IQ68 B1IQ68 ECOLC
MVNVRQPRDVAQILLSVLFLAIMIVACLWIVQPFILGFAWAG

SEQ ID NO: 1985 - protein, 42 aa, Escherichia coli
  misc feature (1)..(42): Escherichia coli (strain ATCC 8739/DSM 1576/Crooks) B1IQR3 B1IQR3 ECOLC
MKQIRLLAQYYVDLMMKLGLVRFSMLLALALVVLAIVVQMAV

SEQ ID NO: 1986 - protein, 43 aa, Escherichia coli
  misc feature (1)..(43): Escherichia coli (strain ATCC 8739/DSM 1576/Crooks) B1IY90 B1IY90 ECOLC
MSRLSPVNQARWARFRHNRRGYWSLWIFLVLFGLSLCSELIAN

SEQ ID NO: 1987 - protein, 43 aa, Escherichia coli
  misc feature (1)..(43): Escherichia coli (strain ATCC 8739/DSM 1576/Crooks) B1IZW5 B1IZW5 ECOLC
MTDYAISKKSKRSLWIPILVFITLAACASAGYSYWHSHQVAAD

SEQ ID NO: 1988 - protein, 43 aa, Escherichia coli
  misc feature (1)..(43): Escherichia coli (strain ATCC 8739/DSM 1576/Crooks) B1IR03 B1IR03 ECOLC
MSKNERMVGISRRTLVKSTAIGSLALAAGGFSLPFTLRNAAAS

SEQ ID NO: 1989 - protein, 43 aa, Escherichia coli
  misc feature (1)..(43): Escherichia coli (strain K12) P77374 YNFE ECOLI
MSKNERMVGISRRTLVKSTAIGSLALAAGGFSLPFTLRNAAAA

SEQ ID NO: 1990 - protein, 43 aa, Escherichia coli
  misc feature (1)..(43): Escherichia coli (strain ATCC 8739/DSM 1576/Crooks) B1J077 B1J077 ECOLC
MSVLINEKLHSHRLKWRWPLSRQVTLSIGTLAVLLTVWWAVAA

SEQ ID NO: 1991 - protein, 44 aa, Escherichia coli
  misc feature (1)..(44): Escherichia coli (strain ATCC 8739/DSM 1576/Crooks) B1IZU1 YEDY ECOLC
MKKNQFLKESDVTAESVFFMKRRQVLKALGISAAALSLPHAAHA

SEQ ID NO: 1992 - protein, 44 aa, Escherichia coli
  misc feature (1)..(44): Escherichia coli (strain ATCC 8739/DSM 1576/Crooks) B1IZX1 B1IZX1 ECOLC
MNATAAQTKSLEWLNRLRANPKIPLIVAGSAAVAVMVALILWAK

SEQ ID NO: 1993 - protein, 44 aa, Escherichia coli
  misc feature (1)..(44): Escherichia coli (strain K12) P76342 YEDY ECOLI
MKKNQFLKESDVTAESVFFMKRRQVLKALGISATALSLPHAAHA

SEQ ID NO: 1994 - protein, 44 aa, Escherichia coli
  misc feature (1)..(44): Escherichia coli O139:H28 (strain E24377A/ETEC) A7ZN92 YEDY ECO24
MKKKQFLKESDVTAESVFFMKRRQVLKALGISAAALSLPHAAHA

SEQ ID NO: 1995 - protein, 44 aa, Escherichia coli; identical to SEQ ID NO: 1991
  misc feature (1)..(44): Escherichia coli O1:K1/APEC A1ACB6 YEDY ECOK1

SEQ ID NO: 1996 - protein, 44 aa, Escherichia coli; identical to SEQ ID NO: 1991
  misc feature (1)..(44): Escherichia coli (strain UTI89/UPEC) Q1RAH1 YEDY ECOUT

SEQ ID NO: 1997 - protein, 44 aa, Escherichia coli; identical to SEQ ID NO: 1991
  misc feature (1)..(44): Escherichia coli O157:H7 Q8XB74 YEDY ECO57

SEQ ID NO: 1998 - protein, 44 aa, Escherichia coli
  misc feature (1)..(44): Escherichia coli O6 Q8FGI7 YEDY ECOL6
MKKNQFLKESDVTAESVFFMKRRQVLKALGISAAAFSLPHAAHA

SEQ ID NO: 1999 - protein, 44 aa, Escherichia coli; identical to SEQ ID NO: 1991
  misc feature (1)..(44): Escherichia coli O9:H4 (strain HS) A8A1H0 YEDY ECOHS

SEQ ID NO: 2000 - protein, 45 aa, Escherichia coli
  misc feature (1)..(45): Escherichia coli (strain K12) P77783 YNFF ECOLI
MKIHTTEALMKAEISRRSLMKTSALGSLALASSAFTLPFSQMVRA

SEQ ID NO: 2001 - protein, 45 aa, Escherichia coli
  misc feature (1)..(45): Escherichia coli (strain K12) P69739 MBHS ECOLI
MNNEETFYQAMRRQGVTRRSFLKYCSLAATSLGLGAGMAPKIAWA

SEQ ID NO: 2002 - protein, 45 aa, Escherichia coli
  misc feature (1)..(45): Escherichia coli (strain K12) P30130 FIMD ECOLI
MSYLNLRLYQRNTQCLHIRKHRLAGFFVRLVVACAFAAQAPLSSA

SEQ ID NO: 2003 - protein, 45 aa, Escherichia coli
  misc feature (1)..(45): Escherichia coli (strain K12) P18775 DMSA ECOLI
MKTKIPDAVLAAEVSRRGLVKTTAIGGLAMASSALTLPFSRIAHA

SEQ ID NO: 2004 - protein, 45 aa, Escherichia coli
  misc feature (1)..(45): Escherichia coli (strain ATCC 8739/DSM 1576/Crooks) B1J031 B1J031 ECOLC
MTILPRHKDVAKSRLKMSNPWHLLAVGFGSGLSPIVPGTMGSLAA

SEQ ID NO: 2005 - protein, 45 aa, Escherichia coli
  misc feature (1)..(45): Escherichia coli (strain K12) P52134 YPJK ECOLI
MPVIAIIAIVIIVIILNKTGVSDSLTALTLATVAALLTGGGAAGA

SEQ ID NO: 2006 - protein, 45 aa, Escherichia coli; identical to SEQ ID NO: 2001
  misc feature (1)..(45): Escherichia coli O6 P69740 MBHS ECOL6

SEQ ID NO: 2007 - protein, 46 aa, Escherichia coli
  misc feature (1)..(46): Escherichia coli (strain ATCC 8739/DSM 1576/Crooks) B1IVW1 B1IVW1 ECOLC
MNNEETFYQAMRRQGVTRRSFLKYCSLAATSLGLGAGMAPKIAWAL

SEQ ID NO: 2008 - protein, 46 aa, Escherichia coli
  misc feature (1)..(46): Escherichia coli (strain ATCC 8739/DSM 1576/Crooks) B1IR94 B1IR94 ECOLC
MKAAAKTQKPKRQEEHANFISWRFALLCGCILLALAFLLGRVAWLQ

SEQ ID NO: 2009 - protein, 46 aa, Escherichia coli
  misc feature (1)..(46): Escherichia coli (strain ATCC 8739/DSM 1576/Crooks) B1IR02 B1IR02 ECOLC
MKIHTTEALMKAEISRRSLMKTSALGSLALASSAFTLPFSQMVRAA

SEQ ID NO: 2010 - protein, 46 aa, Escherichia coli
  misc feature (1)..(46): Escherichia coli (strain ATCC 8739/DSM 1576/Crooks) B1IWM9 B1IWM9 ECOLC
MKTKIPDAVLAAEVSRRGLVKTTAIGGLAMASSALTLPFSRIAHAV

SEQ ID NO: 2011 - protein, 49 aa, Escherichia coli
  misc feature (1)..(49): Escherichia coli (strain ATCC 8739/DSM 1576/Crooks) B1IP71 B1IP71 ECOLC
MNPPINFLPWRQQRRTAFLRFWLLMFVAPLLLAVGITLILRLTGSAEAR

SEQ ID NO: 2012 - protein, 49 aa, Escherichia coli
  misc feature (1)..(49): Escherichia coli O6 Q8FDW4 SAT ECOL6
MNKIYSLKYSAATGGLIAVSELAKRVSGKTNRKLVATMLSLAVAGTVNA

SEQ ID NO: 2013 - protein, 49 aa, Escherichia coli
  misc feature (1)..(49): Escherichia coli Q03155 AIDA ECOLX
MNKAYSIIWSHSRQAWIVASELARGHGFVLAKNTLLVLAVVSTIGNAFA

SEQ ID NO: 2014 - protein, 49 aa, Escherichia coli
  misc feature (1)..(49): Escherichia coli (strain ATCC 8739/DSM 1576/Crooks) B1IZY4 B1IZY4 ECOLC
MFTNNGSTLQTDITTFGVNMKLAHLGRQALMGVMAVALVAGMSVKSFAD

SEQ ID NO: 2015 - protein, 50 aa, Escherichia coli
  misc feature (1)..(50): Escherichia coli (strain ATCC 8739/DSM 1576/Crooks) B1IVM9 B1IVM9 ECOLC
MMDNDNSLNKRPTFKRALRNISITSIFITMMLIWLLLSVTSVLTLKQYAQ

SEQ ID NO: 2016 - protein, 50 aa, Escherichia coli
  misc feature (1)..(50): Escherichia coli (strain ATCC 8739/DSM 1576/Crooks) B1IWN7 B1IWN7 ECOLC
MRALLPYLALYKRHKWMLSLGIVLAIVTLLASIGLLTLSGWFLSASAVAG

SEQ ID NO: 2017 - protein, 52 aa, Escherichia coli
  misc feature (1)..(52): Escherichia coli Q47692 TSH ECOLX
MNRIYSLRYSAVARGFIAVSEFARKCVHKSVRRLCFPVLLLIPVLFSAGSLA

SEQ ID NO: 2018 - protein, 52 aa, Escherichia coli
  misc feature (1)..(52): Escherichia coli (strain K12) P39180 AG43 ECOLI
MKRHLNTCYRLVWNHMTGAFVVASELARARGKRGGVAVALSLAAVTSLPVLA

SEQ ID NO: 2019 - protein, 52 aa, Escherichia coli; identical to SEQ ID NO: 2017
  misc feature (1)..(52): Escherichia coli O88093 HBP ECOLX

SEQ ID NO: 2020 - protein, 52 aa, Escherichia coli
  misc feature (1)..(52): Escherichia coli O68900 PET ECOLX
MNKIYSIKYSAATGGLIAVSELAKKVICKTNRKISAALLSLAVISYTNIIYA

SEQ ID NO: 2021 - protein, 53 aa, Escherichia coli
  misc feature (1)..(53): Escherichia coli O157:H7 Q8X6I9 YAGT ECO57
MSNQGEYPEDNRVGKHEPHDLSLTRRDLIKVSAATAAAAVVYPHSTLAASVPA

SEQ ID NO: 2022 - protein, 53 aa, Escherichia coli
  misc feature (1)..(53): Escherichia coli O127:H6 Q9EZE7 ESPC ECO27
MNKIYALKYCHATGGLIAVSELASRVMKKAARGSLLALFNLSLYGAFLSASQA

SEQ ID NO: 2023 - protein, 53 aa, Escherichia coli
  misc feature (1)..(53): Escherichia coli (strain K12) P77165 YAGT ECOLI
MSNQGEYPEDNRVGKHEPHDLSLTRRDLIKVSAATAATAVVYPHSTLAASVPA

SEQ ID NO: 2024 - protein, 54 aa, Escherichia coli
  misc feature (1)..(54): Escherichia coli Q9XD84 TIBA ECOLX
MNKVYNTVWNESTGTWVVTSELTRKGGLRPRQIKRTVLAGLIAGLLMPSMPALA

SEQ ID NO: 2025 - protein, 55 aa, Escherichia coli
  misc feature (1)..(55): Escherichia coli O32591 ESPP ECOLX
MNKIYSLKYSHITGGLIAVSELSGRVSSRATGKKKHKRILALCFLGLLQSSYSFA

SEQ ID NO: 2026 - protein, 55 aa, Escherichia coli
  misc feature (1)..(55): Escherichia coli O6 Q8CWC7 PIC ECOL6
MNKVYSLKYCPVTGGLIVVSELASRVIKKTCRRLTHILLAGIPAVYLYYPQISQA

SEQ ID NO: 2027 - protein, 55 aa, Escherichia coli
  misc feature (1)..(55): Escherichia coli Q7BS42 PIC ECOLX
MNKVYSLKYCPVTGGLIAVSELARRVIKKTCRRLTHILLAGIPAICLCYSQISQA

SEQ ID NO: 2028 - protein, 55 aa, Escherichia coli; identical to SEQ ID NO: 2025
  misc feature (1)..(55): Escherichia coli O157:H7 Q7BSW5 ESPP ECO57

SEQ ID NO: 2029 - protein, 56 aa, Escherichia coli
  misc feature (1)..(56): Escherichia coli Q84GK0 EATA ECOLX
MNKVFSLKYSFLAKGFIAVSELARRVSVKGKLKSASSIIISPITIAIVSYAPPSLA

SEQ ID NO: 2030 - protein, 22 aa, Escherichia coli
  misc feature (1)..(22): CsgG-mediated Secretion Signal Sequence
GVVPQYGGGGNHGGGGNNSGPN

SEQ ID NO: 2031 - protein, 22 aa, Escherichia coli
  misc feature (1)..(22): CsgG-mediated Secretion Signal Sequence
GVVPQWGGGGNHNGGGNSSGPD

SEQ ID NO: 2032 - protein, 25 aa, Escherichia coli
  misc feature (1)..(25): CsgG-mediated Secretion Signal Sequence
GVVPQYGGGNHGGGNGGGSNNSGPN

SEQ ID NO: 2033 - protein, 17 aa, Escherichia coli
  misc feature (1)..(17): CsgG-mediated Secretion Signal Sequence
GVVPQYGGGGNHGGGGN

SEQ ID NO: 2034 - protein, 19 aa, Escherichia coli
  misc feature (1)..(19): CsgG-mediated Secretion Signal Sequence
IPQYGGGNHGGGGNNSGPN

SEQ ID NO: 2035 - protein, 20 aa, Escherichia coli
  misc feature (1)..(20): CsgG-mediated Secretion Signal Sequence
IPQFGGGGHHGGGGNNSGPN

SEQ ID NO: 2036 - protein, 22 aa, Escherichia coli
  misc feature (1)..(22): CsgG-mediated Secretion Signal Sequence
GVVPQWGGGGNHNGGGNNSGPD

SEQ ID NO: 2037 - protein, 21 aa, Escherichia coli
  misc feature (1)..(21): CsgG-mediated Secretion Signal Sequence
IPQYGGGGGNHGGGGNNSGPN

SEQ ID NO: 2038 - protein, 24 aa, Escherichia coli
  misc feature (1)..(24): CsgG-mediated Secretion Signal Sequence
GAIPQYGGGGGGNHGGGGNNSGPN

SEQ ID NO: 2039 - protein, 20 aa, Escherichia coli
  misc feature (1)..(20): CsgG-mediated Secretion Signal Sequence
IPQYGGGGNHGGGGNNSGPN

SEQ ID NO: 2040 - protein, 21 aa, Escherichia coli
  misc feature (1)..(21): CsgG-mediated Secretion Signal Sequence
GVVPQYGGGNHGGGGNNSGPN

SEQ ID NO: 2041 - protein, 22 aa, Escherichia coli
  misc feature (1)..(22): CsgG-mediated Secretion Signal Sequence
GVVPQYGGGGNLGGGGNNSGPN

SEQ ID NO: 2042 - protein, 22 aa, Escherichia coli
  misc feature (1)..(22): CsgG-mediated Secretion Signal Sequence
GVVPQYGGGGNYGGGGNNSGPN

SEQ ID NO: 2043 - protein, 22 aa, Escherichia coli
  misc feature (1)..(22): CsgG-mediated Secretion Signal Sequence
GAVPQFGGGHGGGWGGGNNGPD

SEQ ID NO: 2044 - protein, 20 aa, Escherichia coli
  misc feature (1)..(20): CsgG-mediated Secretion Signal Sequence
GAIPQYGHGGGWGGGNSGPN

SEQ ID NO: 2045 - protein, 16 aa, Escherichia coli
  misc feature (1)..(16): CsgG-mediated Secretion Signal Sequence
IPQYGGGHGGGSNNGP

SEQ ID NO: 2046 - protein, 22 aa, Escherichia coli
  misc feature (1)..(22): CsgG-mediated Secretion Signal Sequence
GAVPQFGGHGHGHGGGGNSGPD

SEQ ID NO: 2047 - protein, 18 aa, Escherichia coli
  misc feature (1)..(18): CsgG-mediated Secretion Signal Sequence
GLVPQYGGGHGGGNTTGP

SEQ ID NO: 2048 - protein, 20 aa, Escherichia coli
  misc feature (1)..(20): CsgG-mediated Secretion Signal Sequence
GVVPQWGGNHHGGGNNYGPD

SEQ ID NO: 2049 - protein, 21 aa, Escherichia coli
  misc feature (1)..(21): CsgG-mediated Secretion Signal Sequence
GVVPQWGGSGHHNGGNNNGPD

SEQ ID NO: 2050 - protein, 18 aa, Escherichia coli
  misc feature (1)..(18): CsgG-mediated Secretion Signal Sequence
VPQYGNGGGHGGGSNGPN

SEQ ID NO: 2051 - protein, 19 aa, Escherichia coli
  misc feature (1)..(19): CsgG-mediated Secretion Signal Sequence
GLVPQYGGGHGGGGSTTGP

SEQ ID NO: 2052 - protein, 20 aa, Escherichia coli
  misc feature (1)..(20): CsgG-mediated Secretion Signal Sequence
VPQYGHGGNGGWGGNNGGPN

SEQ ID NO: 2053 - protein, 23 aa, Escherichia coli
  misc feature (1)..(23): CsgG-mediated Secretion Signal Sequence
GTVPQFGGGGGHNPGNGNNNGPN

SEQ ID NO: 2054 - protein, 33 aa, Nephila clavipes
GGAGQGGYGGLGSQGAGRGGLGGQGAGAAAAAA

SEQ ID NO: 2055 - protein, 33 aa, Nephila madagascariensis
GGAGQGGYGGLGSQGAGRGGYGGQGAGAAAAAA

SEQ ID NO: 2056 - protein, 23 aa, Nephila senegalensis
GGAGQGGYGGLGGQGAGAAAAAA

SEQ ID NO: 2057 - protein, 42 aa, Tetragnatha kanaiensis
GGLGGGQGAGQGGQQGAGQGGYGSGLGGAGQGASAAAAAAAA

SEQ ID NO: 2058 - protein, 38 aa, Tetragnatha versicolor
GGLGGGQGGYGSGLGGAGQCGQQGAGQGAAAAAASAAA

SEQ ID NO: 2059 - protein, 26 aa, Lactrodectus geometricus
GGAGQGGYGQGGQGGAGAAAAAAAAA

SEQ ID NO: 2060 - protein, 45 aa, Argiope aurantia
  misc feature (6)..(6): Xaa can be any naturally occurring amino acid
GGQGGXGGYGGLGSQGAGQGYGSGLGGQGGAGQGGAAAAAAAAAA

SEQ ID NO: 2061 - protein, 43 aa, Argiope trifasciata
  misc feature (14)..(14): Xaa can be any naturally occurring amino acid
  misc feature (31)..(31): Xaa can be any naturally occurring amino acid
GGQGGQGGYGGLGXQGAGQGYGAGSGGQGGXGQGGAAAAAAAA

SEQ ID NO: 2062 - protein, 39 aa, Araneus diadematus
GGQGGQGGQGGLGSQGAGGAGQGGYGAGQGGAAAAAAAA

SEQ ID NO: 2063 - protein, 40 aa, Nephila clavipes
GPGQQGPGGYGPGQQGPGGYGPGQQGPSGPGSAAAAAAAA

SEQ ID NO: 2064 - protein, 39 aa, Nephila madagascariensis
GPGQQGPGGYGPGQQGPGGYGPGQQGPSGPGSAAAAAAA

SEQ ID NO: 2065 - protein, 22 aa, Nephila senegalensis
  misc feature (9)..(9): Xaa can be any naturally occurring amino acid
GPGQQGPGXYGPSGPGSAAAAA

SEQ ID NO: 2066 - protein, 29 aa, Lactrodectus geometricus
  misc feature (11)..(11): Xaa can be any naturally occurring amino acid
GPGGYGPGPGXQQGYGPGGSGAAAAAAAA

SEQ ID NO: 2067 - protein, 42 aa, Argiope aurantia
  misc feature (28)..(28): Xaa can be any naturally occurring amino acid
GGYGPGAGQQGPGSQGPGSGGQQGPGGXGPYGPSAAAAAAAA

SEQ ID NO: 2068 - protein, 42 aa, Argiope trifasciata
GGYGPGAGQQGPGSQGPGSGGQQGPGGQGPYGPSAAAAAAAA

SEQ ID NO: 2069 - protein, 42 aa, Gasteracantha mammosa
GGYGPGSGQQGPGQQGPGSGGQQGPGGQGPYGPGAAAAAAAA

SEQ ID NO: 2070 - protein, 34 aa, Araneus bicentenarius
GGYGPGSGQQGPGQQGPGQQGPYGPGASAAAAAA

SEQ ID NO: 2071 - protein, 34 aa, Araneus diadematus
GGYGPGSGQQGPGQQGPGGQGPYGPGASAAAAAA

SEQ ID NO: 2072 - protein, 24 aa, Nephila madagascariensis
GRGPGGYGPGQQGPGGPGAAAAAA

SEQ ID NO: 2073 - protein, 32 aa, Argiope trifasciata
GPGGQGPGQQGPGGYGPSGPGGASAAAAAAAA

SEQ ID NO: 2074 - protein, 35 aa, Araneus diadematus
GPGGYGPGSQGPSGPGAYGPGGPGSSAAAAAAAAS

The invention claimed is:

1. A method of producing an engineered *Escherichia coli* (*E. coli*) bacterium comprising
    introducing into an *E. coli* bacterium an exogenous nucleic acid encoding a recombinant protein comprising a Sec domain for periplasmic localization, an N22 domain for directing the recombinant protein to the outer membrane for secretion, and at least one silk fibroin domain comprising the amino acid sequence set forth in SEQ ID NO:3; wherein the *E. coli* bacterium has at least one genomic nucleic acid encoding a Type VIII polypeptide secretion system; and wherein the exogenous nucleic acid is under operation of a promoter to express the recombinant protein.

2. The method of claim 1, wherein the polypeptide secretion system is a HlyA Type 1 secretion system.

3. The method of claim 1, wherein the polypeptide secretion system includes a periplasmic secretion system and a system for secretion through the outer membrane of the bacterium.

4. The method of claim 1, wherein the polypeptide secretion system includes a periplasmic secretion system and a system for secretion through the outer membrane of the bacterium and the domain for periplasmic localization is a Tat domain or a signal recognition particle domain.

5. The method of claim 1, wherein the polypeptide secretion system includes a periplasmic secretion system and a system for secretion through the outer membrane of the bacterium and wherein the domain for directing the recombinant protein to the outer membrane for secretion is a YebF domain.

6. The method of claim 1, wherein the exogenous nucleic acid further encodes the recombinant protein to include a CsgA domain.

7. The method of claim 1, wherein the silk fibroin domain comprises 4 to 64 repeats of the amino acid sequence set forth in SEQ ID NO:3.

8. The method of claim 1, wherein the exogenous nucleic acid further encodes the recombinant protein to include one or more functional proteins comprising an enzyme, an antibody or a detectable protein.

\* \* \* \* \*